United States Patent
Suganuma et al.

(10) Patent No.: US 7,851,592 B2
(45) Date of Patent: Dec. 14, 2010

(54) COMPOSITIONS AND METHODS FOR INHIBITING G2 CELL CYCLE ARREST AND SENSITIZING CELLS TO DNA DAMAGING AGENTS

(75) Inventors: Masashi Suganuma, Toyota (JP); Takumi Kawabe, Numazu (JP)

(73) Assignee: CanBas Co. Ltd., Shizuoka (JP)

( * ) Notice: Subject to any disclaimer, the term of this patent is extended or adjusted under 35 U.S.C. 154(b) by 1055 days.

(21) Appl. No.: 10/967,008

(22) Filed: Oct. 15, 2004

(65) Prior Publication Data
US 2005/0059116 A1 Mar. 17, 2005

Related U.S. Application Data

(62) Division of application No. 09/667,365, filed on Sep. 21, 2000, now Pat. No. 6,881,575.

(30) Foreign Application Priority Data

Sep. 22, 1999 (JP) ................... 11-269398
Nov. 30, 1999 (JP) ................... 11-340322

(51) Int. Cl.
*C07K 14/435* (2006.01)
*C07K 14/47* (2006.01)
*A61K 38/00* (2006.01)
*A61K 48/00* (2006.01)

(52) U.S. Cl. ..................................................... 530/328
(58) Field of Classification Search ................. 530/328
See application file for complete search history.

(56) References Cited

PUBLICATIONS

Pommier et al. (Curr. Pharm. Design 11(22): 2855-2872 (2005).*
Skolnick et al (Trends in Biotechnology, 18(1):34-39, 2000).*
Vile et al (Gene Therapy, vol. 7, pp. 2-8, 2000.*
Rochlitz C. F. (Swiss Medicine Weekly, 131:4-9, 2001).*
Glick (Gen. Engineer. News 28(7) pp. 6 and 9 (Apr. 1, 2008)).*
Verma (Nature, vol. 389, pp. 239-242, 1997).*

* cited by examiner

*Primary Examiner*—Lynn Bristol
(74) *Attorney, Agent, or Firm*—Pillsbury Winthrop Shaw Pittman LLP

(57) ABSTRACT

The invention provides compositions and methods for inhibiting Chk1 and/or Chk2 kinases. Also provided are compositions and methods for inhibiting G2 cell arrest checkpoint, particularly in mammalian, e.g., human, cells. The compositions and methods of the invention are also used to treat disorders of cell growth, such as cancer. In particular, the invention provides methods for selectively sensitizing G1 checkpoint impaired cancer cells to DNA damaging agents and treatments. Also provided are methods for screening for compounds able to interact with, e.g., inhibit, enzymes involved in the G2 cell cycle arrest checkpoint, such as Chk1 and/or Chk2/Cds1 kinase.

19 Claims, 11 Drawing Sheets

Fig. 1
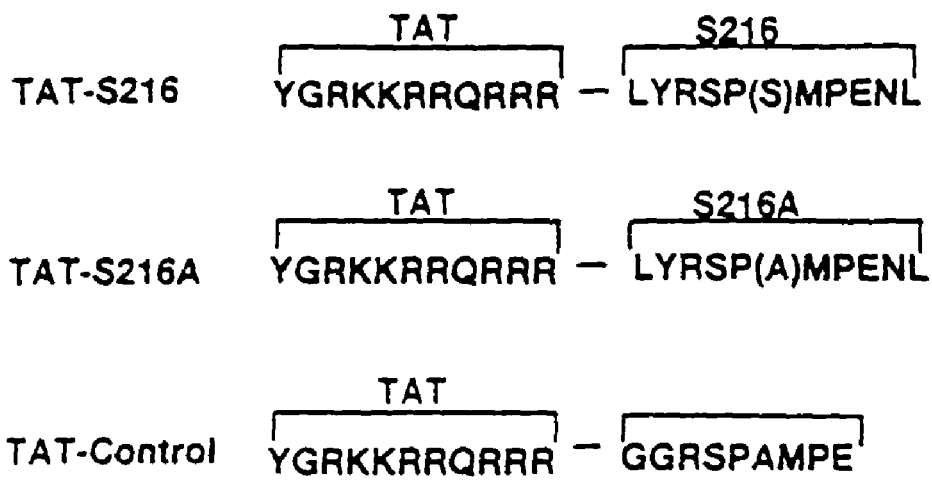
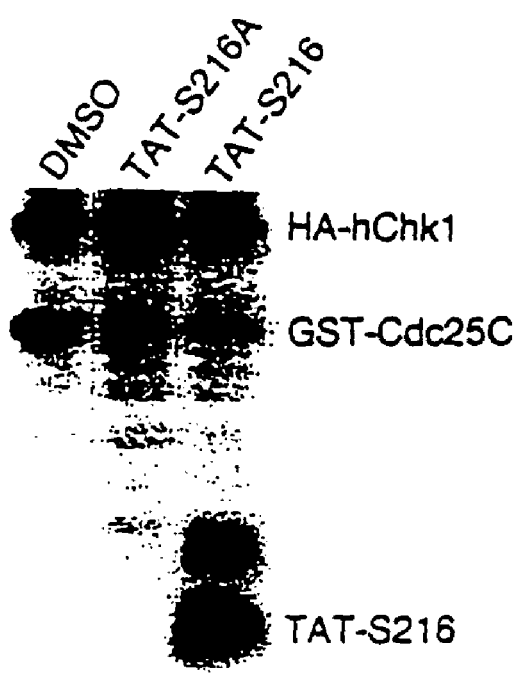
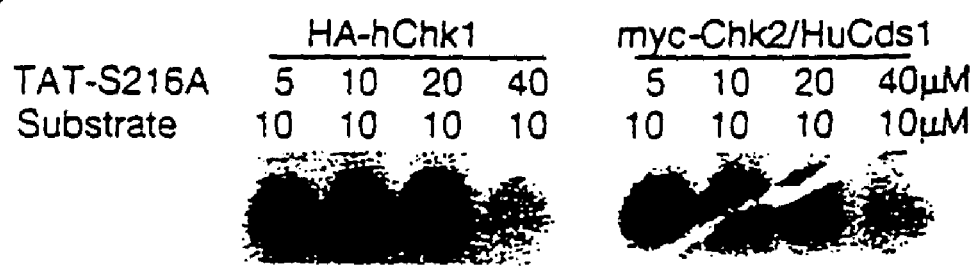

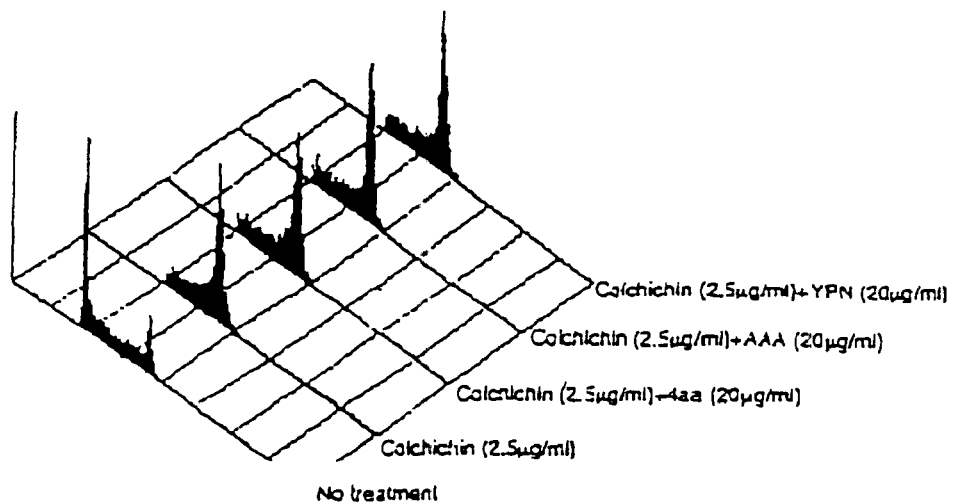
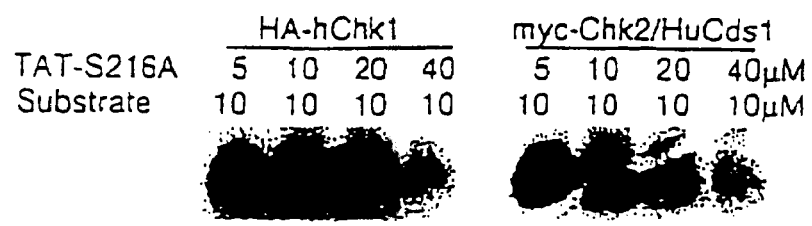
Fig. 7

| Name | Sequences |
|---|---|
| AAA | YGRKKRRQRRR LARSASMPEAL |
| YPN | YGRKKRRQRRR YGGPGGGGN |
| Random I | YGRKKRRQRRR YLSRSPPMNEL |
| Random II | YGRKKRRQRRR RYSLPPELSNM |
| S216A | YGRKKRRQRRR LYRSPAMPENL |
| S216P | YGRKKRRQRRR LYRSPSMPENL |
| SPAMPE | YGRKKRRQRRR GGRSPAMPE |
| SPAMPE | YGRKKRRQRRR GGSPAMP |
| RSPSMP | YGRKKRRQRRR GGRSPSMP |
| SPSMP | YGRKKRRQRRR GGSPSMP |
| SPAM | YGRKKRRQRRR GGSPAM |
| SPSM | YGRKKRRQRRR GGSPSM |
| YG7N | YGRKKRRQRRR YGGGGGGGN |
| YG6N | YGRKKRRQRRR YGGGGGGN |
| YG5N | YGRKKRRQRRR YGGGGGN |
| YXPXN | Tyr-NH(CH2)4CO-Pro-NH(CH2)10CO-Asn |
| YX10N | Tyr-NH(CH2)10CO-Asn |
| YX4N | Tyr-NH(CH2)4CO-Asn |
| TAT-HA | YGRKKRRQRRR YPYDVPDYA |
| TAT-FLAG | YGRKKRRQRRR GGDYKDDDDKG |

Fig. 8

SUMMARY G2 ABROGATION/Bleomycin

|  | 10μM | 20μM | 40μM | 80μM | 160μM |
|---|---|---|---|---|---|
| No peptides | - | - | - | - | - |
| DMSO | - | - | - | - | - |
| FLAG | - | - | - | - | - |
| S216A | + | + | + | + | + |
| S216 | + | + | + | + | + |
| Random II | + | + | + | + | + |
| YPN | - | +/- | + | + | + |
| YG7N | - | +/- | + | + | + |
| YG6N | - | +/- | + | + | + |
| YG5N | - | +/- | + | + | + |
| AAA | - | +/- | + | + | + |
| 4aa | - | - | - | +/- | + |

SUMMARY GstChk2 KINATION INHIBITION

|  | 10μM | 20μM | 40μM | 80μM | 160μM |
|---|---|---|---|---|---|
| No peptides | - | - | - | - | N.D. |
| DMSO | - | - | - | - | N.D. |
| FLAG | - | - | - | - | N.D. |
| S216A | +/- | + | ++ | ++ | N.D. |
| S216 | +/- | + | ++ | ++ | N.D. |
| Random II | +/- | + | ++ | ++ | N.D. |
| YPN | +/- | +/- | + | + | N.D. |
| YG7N | +/- | +/- | + | + | N.D. |
| YG6N | +/- | +/- | + | ++ | N.D. |
| YG5N | +/- | +/- | + | + | N.D. |
| AAA | +/- | +/- | + | + | N.D. |
| 4aa | - | - | - | - | N.D. |

G2 ABROGATION/γ-radiation

|  | 10μM | 20μM | 40μM |
|---|---|---|---|
| No peptides | - | N.D. | - |
| DMSO | - | N.D. | - |
| FLAG | - | N.D. | - |
| S216A | - | N.D. | + |
| Random II | +/- | N.D. | + |

G2 ABROGATION/UV

|  | 10μM | 20μM | 40μM |
|---|---|---|---|
| No peptides | - | N.D. | - |
| DMSO | - | N.D. | - |
| FLAG | - | N.D. | - |
| S216A | - | N.D. | + |
| Random II | - | N.D. | + |

M ABROGATION/Cochicine

|  | 10μM | 20μM | 40μM |
|---|---|---|---|
| No peptides | - | N.D. | - |
| DMSO | - | N.D. | - |
| FLAG | - | N.D. | - |
| S216A | - | N.D. | - |
| Random II | - | N.D. | - |

COMPOSITIONS AND METHODS FOR INHIBITING G2 CELL CYCLE ARREST AND SENSITIZING CELLS TO DNA DAMAGING AGENTS

This application is divisional of U.S. patent application Ser. No. 09/667,365, filed Sep. 21, 2000, now U.S. Pat. No. 6,881,575 which claims priority to Japanese Patent Application Nos. 11-269398, filed Sep. 22, 1999, and 11-340322, filed Nov. 30, 1999.

TECHNICAL FIELD

This invention generally pertains to the fields of medicine and cancer therapeutics. In particular, this invention provides novel genes and polypeptides and methods for making and using them. Specifically, the compositions and methods of the invention are used to treat disorders of cell growth, such as cancer. In particular, the invention provides methods for selectively sensitizing G1 checkpoint impaired cancer cells to DNA damaging agents and treatments. Also provided are methods for screening for compounds able to interact with, e.g., inhibit, enzymes involved in the G2 cell cycle arrest checkpoint, such as Chk1 and/or Chk2/Cds1 kinase.

BACKGROUND

It is a continuing challenge to develop anti-cancer agents that are capable of inhibiting the growth of, or killing, cancer cells, without affecting normal cells. Researchers have focused on genetic mutations in cancer cells to find clues to discover such new anti-cancer drugs.

Many cancer cells have mutations in genes involved in the G1 cell cycle arrest checkpoint. Such genes include impaired tumor suppressor genes, e.g., p53, Rb, p16$^{INK4}$, and p19$^{ARF}$. Alternatively, such mutations can cause expression of oncogenes, e.g., MDM-2 and cyclin D. In addition to these, excessive growth factor signaling can be caused by the over expression of growth factors. Together with these gain-of-function mutations, growth factor receptors or downstream signal-transducing molecules can cause cell transformation by overriding the G1 checkpoint. In contrast, few cancers have disrupted G2 cell cycle arrest checkpoints. Thus, the G2 checkpoint is usually retained in cancer cells with the impaired G1 checkpoint.

If the G2 checkpoint could be selectively disrupted, cancer cells with an impaired G1 checkpoint would become more sensitive to DNA-damaging treatment, as compared to normal cells (with intact G1), since progression through G1 and G2 without repairing such damage induces apoptosis.

The mechanism that promotes the cell cycle G2 arrest after DNA damage is conserved among species from yeast to human. In the presence of damaged DNA, Cdc2/Cyclin B kinase is kept inactive because of inhibitory phosphorylation of threonine-14 and tyrosine-15 residues on Cdc2 kinase. At the onset of mitosis, the dual phosphatase Cdc25 kinase removes these inhibitory phosphates and thereby activates Cdc2/Cyclin B kinase.

In fission yeast, the protein kinase Chk1 is required for the cell cycle arrest in response to damaged DNA. Chk1 kinase acts downstream of several rad gene products and is modified by the phosphorylation upon DNA damage. The kinases Rad53 of budding yeast and Cds1 of fission yeast are known to conduct signals from unreplicated DNA. It appears that there is some redundancy between Chk1 and Cds1 because elimination of both Chk1 and Cds1 was culminated in disruption of the G2 arrest induced by damaged DNA. Interestingly, both Chk1 and Cds1 phosphorylate Cdc25 kinase and promote Rad24 binding to Cdc25, which sequesters Cdc25 to cytosol and prevents Cdc2/Cyclin B activation. Therefore Cdc25 appears to be a common target of theses kinases and presumably an indispensable factor in the G2 checkpoint.

In humans, both hChk1, a human homologue of fission yeast Chk1, and Chk2/HuCds1, a human homologue of the budding yeast Rad53 and fission yeast Cds1, phosphorylate Cdc25C at serine-216, a critical regulatory site, in response to DNA damage. This phosphorylation creates a binding site for small acidic proteins 14-3-3s, human homologues of Rad24 and Rad25 of fission yeast (Lopez-Girona (1999) Nature 397:172-175). The regulatory role of this phosphorylation was clearly indicated by the fact that substitution of serine-216 to alanine on Cdc25C disrupted cell cycle G2 arrest in human cells (Peng (1997) Science 277:1501-1505).

SUMMARY

This invention provides nucleic acids and polypeptides which can be used to treat cell proliferative disorders, such as those associated with benign and malignant tumor cells. While the invention is not limited to any particular mechanisms, the polypeptides of the invention can function by inhibiting the G2 cell cycle arrest checkpoint. Thus, the invention also provides compositions and methods for selectively sensitizing a cell with an impaired G1 cell cycle arrest checkpoint, e.g., a cancer cell, to a DNA damaging agent The invention provides an isolated or recombinant polypeptide comprising the amino acid sequence: $X_1 X_2 X_3 X_4 X_5 X_6 X_7 X_8 X_9 X_{10} X_{11}$, wherein X1 is L, F, W, M, R, I, V, Y, K, or absent, X2 is Y, F, A, W, S or T, X3 is any amino acid, X4 is any amino acid, X5 is any amino acid, X6 is S, A, N, H or P, X7 is any amino acid, X8 is any amino acid, X9 is any amino acid or absent, X10 is N, G, L, S, M, P, N, A or absent, and X11 is L or absent, wherein the polypeptide when administered to or expressed in a cell disrupts the G2 cell cycle arrest checkpoint.

In alternative embodiments, for the isolated or recombinant polypeptide of the invention: $X_1$ is L, F, W, M, R or absent or $X_1$ is L, F or W; $X_2$ is Y, F, A; $X_3$ is R, T, S, H, D, G, A, L, K, A, N, Q or P, or, $X_3$ is R, T, S, H, D, G, A or L, or, $X_3$ is R, T, S or H; $X_4$ is S, T, G, A, L, R, I, M, V, P, or, $X_4$ is S, T, G, A, L, R, or, $X_4$ is S; $X_5$ is P, A, G, S or T, or, $X_5$ is P; $X_6$ is S, N, H, P, A, G or T, or, $X_6$ is S, N or H, or, $X_6$ is S; $X_7$ is M, F, Y, D, E, N, Q, H, G, I, L, V, A, P, N or W, or, $X_7$ is M, F, Y, D, E, N, Q or H, or, $X_7$ is M, F, Y, Q or H; $X_8$ is P, F, Y, W, L, G, M, D, E, N, Q, H, I, V, A or P, or, $X_8$ is P, F, Y or W, or, $X_8$ is Y; $X_9$ is E, G, L, S, M, P, N, D, A, T, P or absent; $X_{10}$ is absent; $X_{11}$ is absent.

In one embodiment, the invention provides a polypeptide wherein $X_2$ is Y, $X_5$ is P, and $X_{10}$ is N. In one embodiment, the invention provides a polypeptide wherein $X_3$ is R, $X_8$ is P, and $X_{11}$ is L. In one embodiment, the invention provides a polypeptide wherein $X_4$ is S, $X_5$ is P, $X_6$ is S, $X_9$ is E, $X_{10}$ is N and $X_{11}$ is L.

In alternative embodiments, the invention provides an isolated or recombinant polypeptide wherein the amino acid sequence comprises Y G G P G G G N (SEQ ID NO: 1895); R Y S L P P E L S N M (SEQ ID NO: 1); L A R S A S M P E A L (SEQ ID NO: 1896); L Y R S P S M P E N L (SEQ ID NO: 2); L Y R S P A M P E N L (SEQ ID NO: 1897); W Y R S P S F Y E N L (SEQ ID NO: 904); W Y R S P S Y Y E N L (SEQ ID NO: 908); or, W Y R S P S Y Y (SEQ ID NO: 1898).

In alternative embodiments, the invention provides an isolated or recombinant polypeptide wherein the amino acid sequence comprises L Y R S P S Y P E N L (SEQ ID NO: 10), L Y R S P S Y F E N L (SEQ ID NO: 11), L Y R S P S Y Y E N L (SEQ ID NO: 12), or L Y R S P S Y W E N L (SEQ ID NO: 13).

In alternative embodiments, the invention provides an isolated or recombinant polypeptide wherein the amino acid sequence comprises L Y R S P S N P E N L (SEQ ID NO: 22), L Y R S P S N F E N L (SEQ ID NO: 23), L Y R S P S N Y E N L (SEQ ID NO: 24), or L Y R S P S N W E N L (SEQ ID NO: 25).

In alternative embodiments, the invention provides an isolated or recombinant polypeptide wherein the amino acid sequence comprises L Y R S P S H P E N L (SEQ ID NO: 30), L Y R S P S H F E N L (SEQ ID NO: 31), L Y R S P S H Y E N L (SEQ ID NO: 32), L Y R S P S H W E N L (SEQ ID NO: 33), L Y S S P S M P E N L (SEQ ID NO: 34), L Y S S P S M F E N L (SEQ ID NO: 35), L Y S S P S M Y E N L (SEQ ID NO: 36), L Y S S P S M W E N L (SEQ ID NO: 37), L Y S S P S F P E N L (SEQ ID NO: 38), L Y S S P S F P E N L (SEQ ID NO: 38), L Y S S P S F F E N L (SEQ ID NO: 39), L Y S S P S F Y E N L (SEQ ID NO: 40), L Y S S P S F W E N L (SEQ ID NO: 41), L Y S S P S Y P E N L (SEQ ID NO: 42), L Y S S P S Y F E N L (SEQ ID NO: 43), L Y S S P S Y Y E N L (SEQ ID NO: 44), or L Y S S P S Y W E N L (SEQ ID NO: 45).

In alternative embodiments, the invention provides an isolated or recombinant polypeptide wherein the amino acid sequence comprises L Y S S P S Q P E N L (SEQ ID NO: 58), L Y S S P S Q W E N L (SEQ ID NO: 61), L Y S S P S H P E N L (SEQ ID NO: 62), L Y S S P S H F E N L (SEQ ID NO: 63), L Y S S P S H Y E N L (SEQ ID NO: 64), L Y S S P S H W E N L (SEQ ID NO: 65), L Y T S P S M P E N L (SEQ ID NO: 66), L Y T S P S M F E N L (SEQ ID NO: 67), L Y T S P S M Y E N L (SEQ ID NO: 68), L Y T S P S M W E N L (SEQ ID NO: 69), L Y T S P S F P E N L (SEQ ID NO: 70), L Y T S P S F F E N L (SEQ ID NO: 71), L Y T S P S F Y E N L (SEQ ID NO: 72), L Y T S P S F W E N L (SEQ ID NO: 73), L Y T S P S Y P E N L (SEQ ID NO: 74), L Y T S P S Y F E N L (SEQ ID NO: 75), L Y T S P S Y Y E N L (SEQ ID NO: 76), or L Y T S P S Y W E N L (SEQ ID NO: 77).

In alternative embodiments, the invention provides an isolated or recombinant polypeptide wherein the amino acid sequence comprises L Y T S P S N P E N L (SEQ ID NO: 86), L Y T S P S N F E N L (SEQ ID NO: 87), L Y T S P S N Y E N L (SEQ ID NO: 88) or L Y T S P S N W E N L (SEQ ID NO: 89).

In alternative embodiments, the invention provides an isolated or recombinant polypeptide wherein the amino acid sequence comprises L Y T S P S H P E N L (SEQ ID NO: 94), L Y T S P S H F E N L (SEQ ID NO: 95), L Y T S P S H Y E N L (SEQ ID NO: 96) or L Y T S P S H W E N L (SEQ ID NO: 97).

In alternative embodiments, the invention provides an isolated or recombinant polypeptide wherein the amino acid sequence comprises L Y H S P S Y P E N L (SEQ ID NO: 106), L Y H S P S Y F E N L (SEQ ID NO: 107), L Y H S P S Y Y E N L (SEQ ID NO: 108) or L Y H S P S Y W E N L (SEQ ID NO: 109).

In alternative embodiments, the invention provides an isolated or recombinant polypeptide wherein the amino acid sequence comprises L F T S P S Y P E N L (SEQ ID NO: 298), L F T S P S Y F E N L (SEQ ID NO: 299), L F T S P S Y Y E N L (SEQ ID NO: 300) or L F T S P S Y W E N L (SEQ ID NO: 301).

In alternative embodiments, the invention provides an isolated or recombinant polypeptide wherein the amino acid sequence comprises F Y S S P S H P E N L (SEQ ID NO: 510), F Y S S P S H F E N L (SEQ ID NO: 511), F Y S S P S H Y E N L (SEQ ID NO: 512), F Y S S P S H W E N L (SEQ ID NO: 513), F Y T S P S M P E N L (SEQ ID NO: 514), F Y T S P S M F E N L (SEQ ID NO: 515), F Y T S P S M Y E N L (SEQ ID NO: 516), F Y T S P S M W E N L (SEQ ID NO: 517), F Y T S P S F P E N L (SEQ ID NO: 518), F Y T S P S F F E N L (SEQ ID NO: 519), F Y T S P S F Y E N L (SEQ ID NO: 520), F Y T S P S F W E N L (SEQ ID NO: 521), F Y T S P S Y P E N L (SEQ ID NO: 522), F Y T S P S Y F E N L (SEQ ID NO: 523), F Y T S P S Y Y E N L (SEQ ID NO: 524) or F Y T S P S Y W E N L (SEQ ID NO: 525).

In alternative embodiments, the invention provides an isolated or recombinant polypeptide wherein the amino acid sequence comprises W Y R S P S M P E N L (SEQ ID NO: 898), W Y R S P S M F E N L (SEQ ID NO: 899), W Y R S P S M Y E N L (SEQ ID NO: 900), W Y R S P S M W E N L (SEQ ID NO: 901), W Y R S P S F P E N L (SEQ ID NO: 902), W Y R S P S F F E N L (SEQ ID NO: 903), W Y R S P S F Y E N L (SEQ ID NO: 904), W Y R S P S F W E N L (SEQ ID NO: 905), W Y R S P S Y P E N L (SEQ ID NO: 906), W Y R S P S Y F E N L (SEQ ID NO: 907), W Y R S P S Y Y E N L (SEQ ID NO: 908) or W Y R S P S Y W E N L (SEQ ID NO: 909).

In alternative embodiments, the invention provides an isolated or recombinant polypeptide wherein the amino acid sequence comprises W Y T S P S M P E N L (SEQ ID NO: 962), W Y T S P S M F E N L (SEQ ID NO: 963), W Y T S P S M Y E N L (SEQ ID NO: 964), W Y T S P S M W E N L (SEQ ID NO: 965), W Y T S P S F P E N L (SEQ ID NO: 966), W Y T S P S F F E N L (SEQ ID NO: 967), W Y T S P S F Y E N L (SEQ ID NO: 968), W Y T S P S F W E N L (SEQ ID NO: 969), W Y T S P S Y P E N L (SEQ ID NO: 970), W Y T S P S Y F E N L (SEQ ID NO: 971), W Y T S P S Y Y E N L (SEQ ID NO: 972) or W Y T S P S Y W E N L (SEQ ID NO: 973).

In alternative embodiments, the invention provides an isolated or recombinant polypeptide wherein the amino acid sequence comprises W Y T S P S H P E N L (SEQ ID NO: 990), W Y T S P S H F E N L (SEQ ID NO: 991), W Y T S P S H Y E N L (SEQ ID NO: 992) or W Y T S P S H W E N L (SEQ ID NO: 993).

In alternative embodiments, the invention provides an isolated or recombinant polypeptide wherein the amino acid sequence comprises L K R S P S M P E N L (SEQ ID NO: 1826), L Y I S P S M P E N L (SEQ ID NO: 1844) or L Y R S P S M V E N L (SEQ ID NO: 1894).

In one embodiment, the invention provides an isolated or recombinant polypeptide wherein the polypeptide when administered to or expressed in a cell disrupts the G2 cell cycle arrest checkpoint, wherein the cell is a mammalian cell. The cell can be a human cell, a yeast cell, an insect cell, a bacterial cell, a plant cell, and the like.

In one embodiment, the invention provides an isolated or recombinant polypeptide further comprising a cell membrane permeant. The cell membrane permeant can comprise a polypeptide, such as a TAT protein transduction domain, e.g., comprising a sequence Y G R K K R R Q R R R (SEQ ID NO: 1899). Alternatively, the cell membrane permeant can comprise a lipid, such as a liposome.

The invention provides a chimeric polypeptide comprising a first domain comprising a polypeptide of the invention and a second domain comprising a cell membrane permeant, wherein the polypeptide when administered to or expressed in a cell disrupts the G2 cell cycle arrest checkpoint. The chimeric polypeptide can be a recombinant fusion protein.

The invention provides an isolated or recombinant nucleic acid encoding a polypeptide or a chimeric polypeptide of the invention, wherein the polypeptide, when administered to or expressed in a cell, disrupts the G2 cell cycle arrest checkpoint.

The invention provides an expression vector comprising a nucleic acid encoding a polypeptide or a chimeric polypeptide of the invention, wherein the polypeptide, when administered to or expressed in a cell, disrupts the G2 cell cycle arrest checkpoint.

The invention provides a cell comprising a nucleic acid or an expression vector of the invention. The cell can be a bacterial, a yeast, an insect, a plant, or a mammalian cell.

The invention provides a pharmaceutical composition comprising a polypeptide of the invention, a nucleic acid of the invention, an expression vector of the invention, or a cell of the invention; and, a pharmaceutically acceptable excipient. In one embodiment, the pharmaceutical composition can comprise a liposome.

The invention provides a method for inhibiting a the activity of a Chk1 kinase or a Chk2 kinase comprising contacting the kinase with a polypeptide of the invention or a pharmaceutical composition of the invention, in an amount sufficient to inhibit the activity of the Chk1 or Chk2 kinase.

The invention provides a method for disrupting a cell G2 cell cycle arrest checkpoint comprising contacting the cell with a polypeptide of the invention or a pharmaceutical composition of the invention in an amount sufficient to disrupt the G2 cell cycle arrest checkpoint. In alternative embodiments the cell is a mammalian cell, a human cell or a cancer cell.

The invention provides a method for sensitizing a cell to a DNA damaging agent comprising contacting the cell with a polypeptide of the invention or a pharmaceutical composition of the invention in an amount sufficient to disrupt the G2 cell cycle arrest checkpoint, thereby sensitizing the cell to the DNA damaging agent. In alternative embodiments the cell is a mammalian cell, a human cell or a cancer cell. The cancer cell can have an impaired G1 cell cycle arrest checkpoint.

The invention provides a method for selectively sensitizing a cell with an impaired G1 cell cycle arrest checkpoint to a DNA damaging agent comprising contacting the cell with a polypeptide of the invention or a pharmaceutical composition of the invention, in an amount sufficient to disrupt the G2 cell cycle arrest checkpoint, thereby sensitizing the cell to the DNA damaging agent. In alternative embodiments the cell is a mammalian cell, a human cell or a cancer cell.

The invention provides a method for inducing apoptosis in a cell in an individual comprising a administering a polypeptide of the invention or a pharmaceutical composition of the invention, in an amount sufficient to disrupt the G2 cell cycle arrest checkpoint in the cancer cell, thereby sensitizing the cancer cell to a DNA damaging agent, and administering a DNA damaging agent. In alternative embodiments the cell is a mammalian cell, a human cell or a cancer cell. The cancer cell can have an impaired G1 cell cycle arrest checkpoint. The DNA damaging agent can be 5-fluorouracil (5-FU), rebeccamycin, adriamycin, bleomycin, cisplatin, hyperthermia, UV irradiation or gamma-irradiation.

The invention provides a method for screening for compounds capable of modulating the activity of a Chk1 kinase or a Chk2 kinase comprising the following steps: (a) providing a test compound; (b) providing a Chk1 kinase or a Chk2 kinase; (c) providing a polypeptide of the invention, wherein the polypeptide binds to the Chk1 kinase or the Chk2 kinase; and, (d) contacting the test compound with the kinase and the polypeptide and measuring the ability of the test compound to prevent binding of the polypeptide to the kinase.

The invention provides a method for screening for compounds capable of modulating the activity of a Chk1 kinase or a Chk2 kinase comprising the following steps: (a) providing a test compound; (b) providing a Chk1 kinase or a Chk2 kinase; (c), providing a polypeptide of the invention, wherein the polypeptide is phosphorylated by the Chk1 kinase or the Chk2 kinase; and, (d) contacting the test compound with the kinase and the polypeptide and measuring the ability of the test compound to inhibit or abrogate phosphorylation of the polypeptide by the kinase. The method can further comprising providing a full length human Cdc25C. In one embodiment, of the method, the polypeptide of step (c) comprises amino acid residue serine 216 of human Cdc25C, such as comprising from about amino acid residue 200 to about amino acid residue 250 of human Cdc25C. In one embodiment of the method, the polypeptide of step (c) further comprises glutathione-S-transferase.

In one embodiment of the methods of the invention, including the screening methods, the polypeptide of the invention is immobilized.

The invention provides a method for screening for compounds capable of specifically inhibiting the G2 cell cycle checkpoint comprising the following steps: (a) providing a test compound and a polypeptide of the invention; (b) providing a G1 checkpoint impaired cell; (c) contacting the cell of step (b) with the test compound or the polypeptide of step (a) plus a DNA damaging treatment, such as 5-fluorouracil (5-FU), rebeccamycin, adriamycin, bleomycin, cisplatin, hyperthermia, UV irradiation or gamma-irradiation, or, or an M phase checkpoint activator; and, (d) measuring the amount of DNA in the cells after the contacting of step (c) to determine if the test compound has inhibited the G2 cell cycle checkpoint, wherein the polypeptide of step (a) acts as a G2-checkpoint-inhibiting positive control. In alternative embodiments the cell is a mammalian cell, a human cell or a cancer cell. In one embodiment, the amount of DNA is measured using propidium iodide by, e.g., a FACS analysis, or equivalent. In one embodiment, the amount of DNA is measured after about 10 to about 72 hours after the contacting of step (c).

In one embodiment, the method comprises contacting the cell of step (b) with an M phase checkpoint activator alone (as a substitute for a DNA damaging agent) and the test compound or the polypeptide of step (a), wherein a test compound that has not inhibited or abrogated the arrest at the M phase checkpoint of the cell cycle after contacting the cell with an M phase activator is a specific inhibitor of the G2 cell cycle checkpoint (because it did not affect M phase checkpoint or it was not a non-specific phenomenon). In one embodiment, the M phase checkpoint activator is colchicine or nocodazole.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

DESCRIPTION OF DRAWINGS

FIG. 1 shows chimeric peptides used in and results of experiments demonstrating that TAT-S216A and TAT-S216 peptides inhibit hChk1 and Chk2/HuCds1 kinase activity in vitro, as described in Example 1, below. FIG. 1A shows a schematic diagram of the fusion/chimeric peptides TAT-control (SEQ ID NO: 1934), TAT-S216A (SEQ ID NO: 1933) and TAT-S216 (SEQ ID NO: 1932). FIG. 1B shows SDS-PAGE autoradiograms demonstrating the results of in vitro Cdc25C phosphorylation assays using TAT-S216A and TAT-S216 peptides to inhibit purified hChk1 activity; amino acid residues 200 to 256 of Cdc25C (SEQ ID NO:1) were used as a substrate at a concentration of 1 µM. FIG. 1C shows SDS-PAGE autoradiograms demonstrating the results of in vitro Cdc25C phosphorylation assays using TAT-S216A peptide to inhibit purified hChk1 and Chk2/HuCds1 activity; amino acid residues 211 to 220 of Cdc25C (SEQ ID NO:1) were used as a substrate at a concentration of 10 µM.

FIG. 2A shows the results of a FACS analysis of Jurkat cells treated with bleomycin (10 µg/ml) and TAT-S216A and TAT-S216 peptides (10 µM each). FIG. 2B shows the results of an SDS-PAGE of cell lysates from a histone H1 kinase analysis; lysates were prepared from cells treated with the indicated reagent for six hours. FIG. 2C shows the results a FACS analysis of colchicines—(5 µg/ml) and peptide—(10 µM each) treated cells; Jurkat cells were treated for 20 hours.

FIG. 3A shows the results of trypan blue dye exclusion analysis of Jurkat cells treated with bleomycin with or without the TAT-S216A and TAT-S216 peptides. FIG. 3B shows the results of trypan blue dye exclusion (survival) analysis of Jurkat cells treated with colchicine with or without the TAT-S216A and TAT-S216 peptides. FIG. 3C shows the results of trypan blue dye exclusion (survival) analysis of PHA blasts treated with bleomycin with or without the TAT-S216A and TAT-S216 peptides. FIG. 3D shows the results of FACS analysis PHA blasts treated with bleomycin with or without the TAT-S216A and TAT-S216 peptides (vertical axis is DNA content indicated by propidium iodide staining).

FIG. 4A shows the results of X-TT analysis of PANC1 cells treated with bleomycin with or without the TAT-S216A and TAT-S216 peptides. FIG. 4B shows the results of X-TT analysis of MIA PaCa2 cells treated with bleomycin with or without the TAT-S216A and TAT-S216 peptides.

FIG. 7 shows the results of FACS analysis of the amount of DNA in cells to determine the number of cells in one of the four cell cycle phases after incubating these cells with colchicine and exemplary peptides of the invention, as described in Example 3, below.

FIG. 8 shows the sequences of peptides (SEQ ID NOS 1935-1948) used in experiments described in Example 4, below.

FIG. 9 shows a summary of results of experiments as described in Example 4, below.

Like reference symbols in the various drawings indicate like elements.

DETAILED DESCRIPTION

Figure 2:
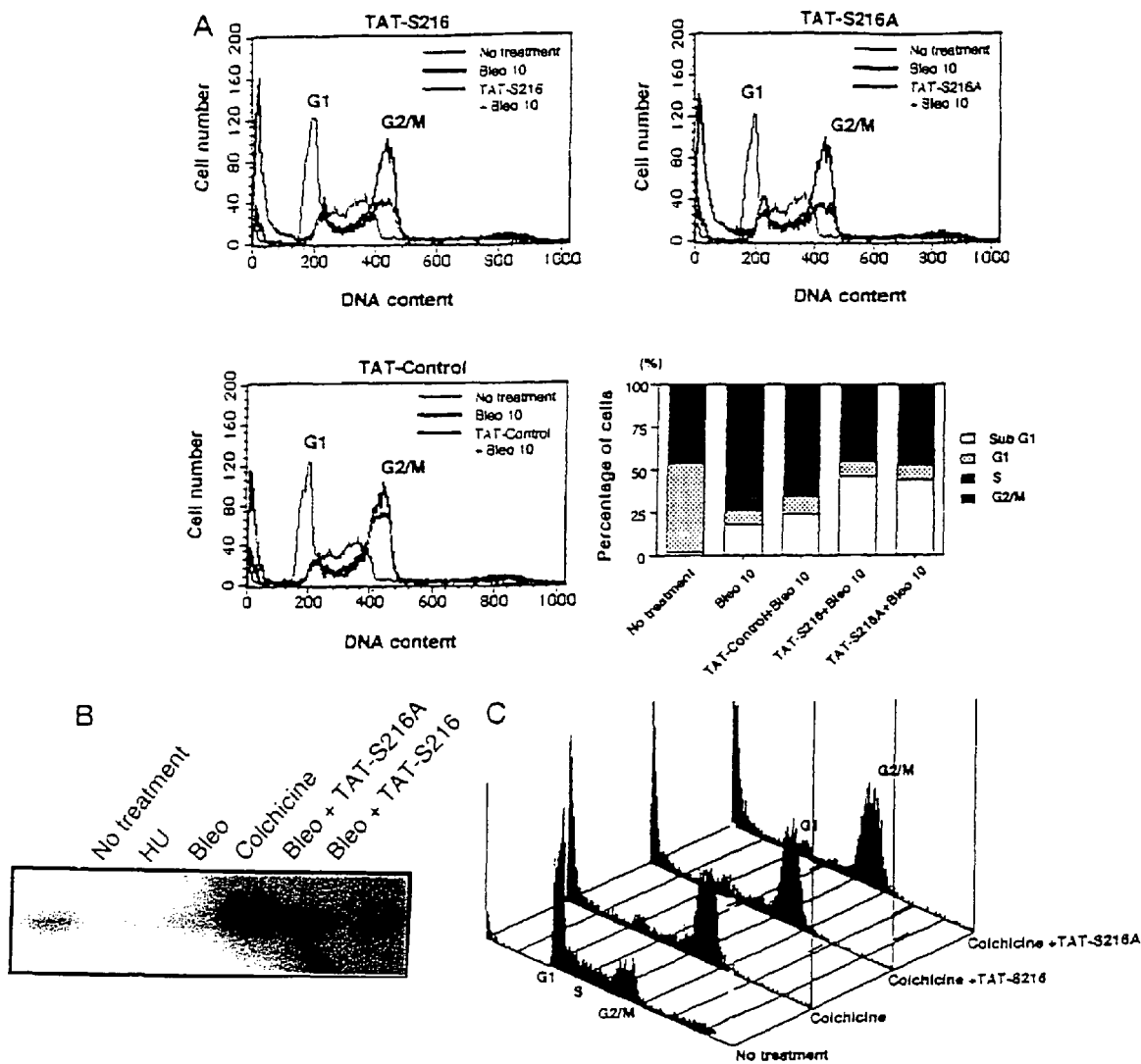
FIG. 2 the results of experiments demonstrating that TAT-S216A and TAT-S216 peptides can abrogate DNA damage-induced G2 arrest in Jurkat cells.

The genes and polypeptides of the invention provide a novel means to treat cell proliferative disorders, including, e.g., to stop the growth of, or kill, cancer cells. While the invention is not limited by any particular mechanism of action, administration of the polypeptides of the invention will delay or abrogate G2 cell cycle arrest checkpoint in cells. The genes and polypeptides of the invention can also be used to inhibit Chk1 and/or Chk2/Cds1 kinase activity. Inhibition of Chk1 and/or Chk2/Cds1 kinase may be the mechanism by which the G2 checkpoint is inhibited. The invention also provides methods for selectively sensitizing G1 checkpoint impaired cancer cells to DNA damaging agents and treatments. Also provided are methods for screening for compounds able to interact with, e.g., inhibit, enzymes involved in the G2 cell cycle arrest checkpoint, such as Chk1 and/or Chk2/Cds1 kinases. Thus, the invention provides methods to screen for compounds that inhibit or abrogate cell cycle G2 checkpoint.

The invention for the first time describes amino acid peptide motifs in the human Cdc25C (hCdc25C) polypeptide (SEQ ID NO:1) that are the substrate motifs for human Chk1 (hChk1) (SEQ ID NO:3) and human Chk2/ human Cds1 (Chk2/HuCds1) (SEQ ID NO:4) kinase activity. The kinase-inhibitory polypeptides and nucleic acids of the invention are modeled on these hCdc25C peptide motifs. Wild-type hCdc25C is phosphorylated by hChk1 (SEQ ID NO:3) and Chk2/HuCds1 (SEQ ID NO:4).

Phosphorylation of Cdc25C is necessary for the cell's arrest at G2 checkpoint. Thus, the polypeptides and peptides of the invention, by inhibiting the phosphorylation of Cdc25C (by enzymes which probably include Chk1 and Chk2/HuCds1), can inhibit or abrogate the cell's G2 checkpoint capability. The lack of an effective G2 checkpoint after DNA damage becomes fatal to the cell (see, e.g., Maity (1994) Radiother. Oncol. 31:1-13). If a cell progresses through G2 without sufficient repair of DNA damage it becomes apoptotic. Thus, the compositions of the invention can be used to sensitize cells, such as tumor cells, to DNA damaging agents. In fact, as discussed below, the compositions of the invention can sensitize cancer cells to the apoptotic effects of DNA-damaging agents with little or no cytotoxic effect on normal cells.

Example 1, below, describes the synthesis and use of two exemplary polypeptides of the invention. Two peptides corresponding to amino acids 211 to 221 of human Cdc25C (SEQ ID NO:1) fused with a part of HIV-1-TAT (SEQ ID NO:5). These peptides were demonstrated to inhibit hChk1 kinase (SEQ ID NO:3) and Chk2/HuCds1 kinase (SEQ ID NO:4) activity in vitro and to specifically abrogate the G2 checkpoint in vivo. These peptides sensitized p53-defective cancer cell lines to the apoptotic effects of DNA-damaging agents without obvious cytotoxic effect on normal cells. These results clearly demonstrate that the polypeptides comprising the motifs of the invention can be used to specifically inhibit or abrogate the cell cycle G2 checkpoint. These results demonstrate that the compositions of the invention can be used to screen for compositions that inhibit Chk1 or Chk2 kinase activity. These results also demonstrate that the compositions of the invention can be used for cancer therapy. While the invention is not limited by any particular mechanism of action, the polypeptides and peptides of the invention can be used to target and inhibit hChk1 (SEQ ID NO:3) and Chk2/HuCds1 (SEQ ID NO:4) kinases.

Definitions

Unless defined otherwise, all technical and scientific terms used herein have the meaning commonly understood by a person skilled in the art to which this invention belongs. As used herein, the following terms have the meanings ascribed to them unless specified otherwise.

The term "cell membrane permeant" as used herein means any composition which, when associated with a peptide or polypeptide of the invention, or a nucleic acid of the invention, causes, or assists in, the internalization of the composition into a cell. The association can be covalent (e.g., a linking reagent, or, as a fusion protein) or non-covalent (e.g., as with liposomes). For example, in one embodiment, a cell membrane permeant domain is linked to a peptide or polypeptide of the invention as a fusion protein domain, e.g., a TAT protein transduction domain (see, e.g., Vives (1997) J. Biol. Chem. 272:16010-16017). Other cell membrane permeant domains include, e.g., the PreS2- and S-domain of the hepatitis-B virus surface antigens, see, e.g., Oess (2000) Gene Ther. 7:750-758.

The term "human Cdc25C" or "hCdc25C" as used herein means, depending on the context, the human Cdc25C polypeptide (SEQ ID NO:1) or the human Cdc25C polypeptide (SEQ ID NO:1) message (cDNA) (SEQ ID NO:2) or gene (see, e.g., Peng (1997) Science 277:1501-1505). The term also includes all functional variations of hCdc25C, including, e.g., allelic variations, functional mutations, variations with additions, deletions, substitutions that retain functional activity. A Cdc25C polypeptide that has functional activity has the same activity as wild type Cdc25C, i.e., when appropriately phosphorylated, it can act in concert with other cell cycle control polypeptides to arrest cell growth at G2 under the proper conditions, e.g., under conditions in which sufficient DNA damage has incurred to induce apoptosis if the cell passes through the G2 checkpoint.

The terms "DNA damaging treatment" or "DNA damaging agent" include any treatments or agents that will cause DNA damage to a cell, including a drug, a radiation, an environmental shock, and the like, including, e.g., hyperthermia, UV radiation or gamma-radiation, in addition to the known DNA damaging drugs, e.g., 5-fluorouracil (5-FU), rebeccamycin, adriamycin, bleomycin, cisplatin and the like.

The term "disrupt the cell cycle G2 checkpoint" or "inhibit the cell cycle G2 checkpoint" means the ability of a peptide or polypeptide of the invention to inhibit (including abrogate) a Chk1 kinase and/or Chk2 kinase activity, e.g., a mammalian kinase, such as a human Chk1 (hChk1) kinase (SEQ ID NO:3) (see, e.g., Yin (2000) Mol. Pharmacol. 57:453-459) or a human Chk2/human Cds1 kinase (Chk2/HuCds1) (SEQ ID NO:4) (see, e.g., Hirao (2000) Science 287:1824-1827), or, to disrupt (including abrogate) the ability of a cell to arrest growth at the G2 checkpoint under appropriate conditions, e.g., where conditions in the cell otherwise would cause G2 cell cycle arrest, such as the accumulation of DNA damage by, e.g., some anti-tumor agents.

The ability of a peptide or polypeptide of the invention to modulate or inhibit a Chk1 kinase and/or a Chk2 kinase activity can be easily tested in vitro or in vivo as, for example, in the assays, or variations thereof, described in Example 1, below. A peptide or polypeptide is considered an effective inhibitor if, e.g., it binds the kinase to inhibit or abrogate kinase activity. Alternatively, a peptide or polypeptide is also considered an effective inhibitor of kinase activity if it acts as a phosphorylation substrate and prevents phosphorylation of natural substrate, e.g., wild type Cdc25C, thereby disrupt the ability of a cell to arrest growth at the G2 checkpoint under appropriate conditions.

The ability of exemplary peptides or polypeptides of the invention to disrupt the ability of a cell to arrest growth at the G2 checkpoint, i.e., to act in concert with other cell cycle control polypeptides to arrest cell growth at G2 under the proper conditions, e.g., under conditions in which sufficient DNA damage has incurred to induce apoptosis if the cell passes through the G2 checkpoint can be easily tested in vivo, e.g., cell culture, is demonstrated in Example 1, below The term "expression cassette" as used herein refers to a nucleotide sequence which is capable of affecting expression of a structural gene (i.e., a protein coding sequence) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers. "Operably linked" as used herein refers to linkage of a promoter upstream from a DNA sequence such that the promoter mediates transcription of the DNA sequence. Thus, expression cassettes also include plasmids, expression vectors, recombinant viruses, any form of recombinant "naked DNA" vector, and the like. A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and includes both the expression and nonexpression plasmids. Where a recombinant microorganism or cell culture is described as hosting an "expression vector" this includes both extrachromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

The term "chemically linked" refers to any chemical bonding of two moieties, e.g., as in one embodiment of the invention, a polypeptide comprising at least two peptide motifs of the invention. Such chemical linking includes the peptide bonding of a recombinantly or in vivo generated fusion protein.

The term "chimeric protein" or "fusion protein" refers to a composition comprising at least one polypeptide or peptide domain or motif which is associated with a second polypeptide or peptide domain or motif. For example, in one embodiment, the invention provides an isolated or recombinant nucleic acid molecule encoding a fusion protein comprising at least two domains, wherein the first domain comprises one kinase-inhibiting or G2-checkpoint inhibiting motif and the second domain comprising a second motif with the same or similar activity (for example, on motif may have a high binding affinity for the kinase, whilst the second motif has high kinase inhibitory activity). Additional domains can comprise a polypeptide, peptide, polysaccharide, or the like. The "fusion" can be an association generated by a peptide bond, a chemical linking, a charge interaction (e.g., electrostatic attractions, such as salt bridges, H-bonding, etc.) or the like. If the polypeptides are recombinant, the "fusion protein" can be translated from a common message. Alternatively, the compositions of the domains can be linked by any chemical or electrostatic means. The chimeric molecules of the invention can also include additional sequences, e.g., linkers, epitope tags, enzyme cleavage recognition sequences, signal sequences, secretion signals, and the like. Alternatively, a peptide can be linked to a carrier simply to facilitate manipulation or identification/ location of the peptide.

The term "G2 checkpoint inhibitory activity" as used herein means any amount of inhibition of the G2 checkpoint.

The term "isolated" as used herein, when referring to a molecule or composition, such as, e.g., a nucleic acid or polypeptide of the invention, means that the molecule or composition is separated from at least one other compound, such as a protein, other nucleic acids (e.g., RNAs), or other contaminants with which it is associated in vivo or in its naturally occurring state. Thus, a nucleic acid or polypeptide is considered isolated when it has been isolated from any other component with which it is naturally associated, e.g., cell membrane, as in a cell extract. An isolated composition can, however, also be substantially pure. An isolated composition can be in a homogeneous state and can be in a dry or an aqueous solution. Purity and homogeneity can be determined, for example, using analytical chemistry techniques such as polyacrylamide gel electrophoresis (SDS-PAGE) or high performance liquid chromatography (HPLC). Thus, the isolated compositions of this invention do not contain materials normally associated with their in situ environment. Even where a protein has been isolated to a homogenous or dominant band, there can be trace contaminants which co-purify with the desired protein.

The terms "polypeptide," "protein," and "peptide" include compositions of the invention that also include "analogs," or "conservative variants" and "mimetics" or "peptidomimetics" with structures and activity that substantially correspond to the polypeptide from which the variant was derived, including, e.g., variations of the peptides and polypeptides of the invention which can either inhibit a mammalian Chk1 and/or Chk2 kinase, or, inhibit a mammalian G2 checkpoint.

The term "pharmaceutical composition" refers to a composition suitable for pharmaceutical use, e.g., as an anticancer agent, in a subject. The pharmaceutical compositions of this invention are formulations that comprise a pharmacologically effective amount of a composition comprising, e.g., a peptide, polypeptide, nucleic acid, vector, or cell of the invention, and a pharmaceutically acceptable carrier.

The term "promoter" is an array of nucleic acid control sequences which direct transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements which can be located as much as several thousand base pairs from the start site of transcription. A "constitutive" promoter is a promoter which is active under most environmental and developmental conditions. An "inducible" promoter is a promoter which is under environmental or developmental regulation. A "tissue specific" promoter is active in certain tissue types of an organism, but not in other tissue types from the same organism. The term "operably linked" refers to a functional linkage between a nucleic acid expression control sequence (such as a promoter, or array of transcription factor binding sites) and a second nucleic acid sequence, wherein the expression control sequence directs transcription of the nucleic acid corresponding to the second sequence.

The term "recombinant" refers to a polynucleotide synthesized or otherwise manipulated in vitro (e.g., "recombinant polynucleotide"), to methods of using recombinant polynucleotides to produce gene products in cells or other biological systems, or to a polypeptide ("recombinant protein") encoded by a recombinant polynucleotide. For example, recombinant peptides or polypeptides or nucleic acids can be used to practice the methods of the invention. "Recombinant means" also encompass the ligation of nucleic acids having various coding regions or domains or promoter sequences from different sources into an expression cassette or vector for expression of, e.g., inducible or constitutive expression of polypeptide coding sequences in the vectors used to practice this invention.

Nucleic Acids and Expression Vectors

This invention provides novel nucleic acids, including expression vectors, for use in the treatment of uncontrolled cell growth, such as cancer, and means to make and express those nucleic acids. As the genes and vectors of the invention can be made and expressed in vitro or in vivo, the invention provides for a variety of means of making and expressing these genes and vectors. One of skill will recognize that desired levels of expression of the polypeptides of the invention can be obtained by modulating the expression or activity of the genes and nucleic acids (e.g., promoters) within the vectors of the invention. Any of the known methods described for increasing or decreasing expression or activity, including tissue-specific expression, can be used for this invention. The invention can be practiced in conjunction with any method or protocol known in the art, which are well described in the scientific and patent literature.

General Techniques

The nucleic acid sequences of the invention and other nucleic acids used to practice this invention, whether RNA, cDNA, genomic DNA, vectors, viruses or hybrids thereof, may be isolated from a variety of sources, genetically engineered, amplified, and/or expressed recombinantly. Any recombinant expression system can be used, including, in addition to bacterial cells, e.g., mammalian, yeast, insect or plant cell expression systems.

Alternatively, these nucleic acids can be synthesized in vitro by well-known chemical synthesis techniques, as described in, e.g., Carruthers (1982) Cold Spring Harbor Symp. Quant. Biol. 47:411-418; Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066. Double stranded DNA fragments may then be obtained either by synthesizing the complementary strand and annealing the strands together under appropriate conditions, or by adding the complementary strand using DNA polymerase with an appropriate primer sequence.

Techniques for the manipulation of nucleic acids, such as, e.g., generating mutations in sequences, subcloning, labeling probes, sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Nucleic acids, vectors, capsids, polypeptides, and the like can be analyzed and quantified by any of a number of general means well known to those of skill in the art. These include, e.g., analytical biochemical methods such as NMR, spectrophotometry, radiography, electrophoresis, capillary electrophoresis, high performance liquid chromatography (HPLC), thin layer chromatography (TLC), and hyperdiffusion chromatography, various immunological methods, e.g. fluid or gel precipitin reactions, immunodiffusion, immuno-electrophoresis, radioimmunoassays (RIAs), enzyme-linked immunosorbent assays (ELISAs), immuno-fluorescent assays, Southern analysis, Northern analysis, dot-blot analysis, gel electrophoresis (e.g., SDS-PAGE), nucleic acid or target or signal amplification methods, radiolabeling, scintillation counting, and affinity chromatography. Amplification methods include, e.g., polymerase chain reaction, PCR (PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Once amplified, the libraries can be cloned, if desired, into any of a variety of vectors using routine molecular biological methods; methods for cloning in vitro amplified nucleic acids are described, e.g., U.S. Pat. No. 5,426,039. To facilitate cloning of amplified sequences, restriction enzyme sites can be "built into" the PCR primer pair.

The invention provides libraries of expression vectors encoding polypeptides and peptides of the invention. These nucleic acids may be introduced into a genome or into the cytoplasm or a nucleus of a cell and expressed by a variety of conventional techniques, well described in the scientific and patent literature. See, e.g., Roberts (1987) Nature 328:731; Schneider (1995) Protein Expr. Purif. 6435:10; Sambrook, Tijssen or Ausubel. The vectors can be isolated from natural sources, obtained from such sources as ATCC or GenBank libraries, or prepared by synthetic or recombinant methods. For example, the nucleic acids of the invention can be expressed in expression cassettes, vectors or viruses which are stably or transiently expressed in cells (e.g., episomal expression systems). Selection markers can be incorporated into expression cassettes and vectors to confer a selectable phenotype on transformed cells and sequences. For example, selection markers can code for episomal maintenance and replication such that integration into the host genome is not required.

In one embodiment, the nucleic acids of the invention are administered in vivo for in situ expression of the peptides or polypeptides of the invention. The nucleic acids can be administered as "naked DNA" (see, e.g., U.S. Pat. No. 5,580,859) or in the form of an expression vector, e.g., a recombinant virus. The nucleic acids can be administered by any route, including peri- or intra-tumorally, as described below.

Vectors administered in vivo can be derived from viral genomes, including recombinantly modified enveloped or non-enveloped DNA and RNA viruses, preferably selected from baculoviridiae, parvoviridiae, picornoviridiae, herpesveridiae, poxviridae, adenoviridiae, or picornnaviridiae. Chimeric vectors may also be employed which exploit advantageous merits of each of the parent vector properties (See e.g., Feng (1997) Nature Biotechnology 15:866-870). Such viral genomes may be modified by recombinant DNA techniques to include the nucleic acids of the invention; and may be further engineered to be replication deficient, conditionally replicating or replication competent. In alternative embodiments, vectors are derived from the adenoviral (e.g., replication incompetent vectors derived from the human adenovirus genome, see, e.g., U.S. Pat. Nos. 6,096,718; 6,110,458; 6,113,913; 5,631,236); adeno-associated viral and retroviral genomes. Retroviral vectors can include those based upon murine leukemia virus (MuLV), gibbon ape leukemia virus (GaLV), Simian Immuno deficiency virus (SIV), human immuno deficiency virus (HIV), and combinations thereof; see, e.g., U.S. Pat. Nos. 6,117,681; 6,107,478; 5,658,775; 5,449,614; Buchscher (1992) J. Virol. 66:2731-2739; Johann (1992) J. Virol. 66:1635-1640). Adeno-associated virus (AAV)-based vectors can be used to transduce cells with target nucleic acids, e.g., in the in vitro production of nucleic acids and peptides, and in in vivo and ex vivo gene therapy procedures; see, e.g., U.S. Pat. Nos. 6,110,456; 5,474,935; Okada (1996) Gene Ther. 3:957-964.

The peptides and polypeptides of the invention are derived from, or based on, the structure of the kinase Cdc25C. The cDNA nucleic acid sequence for hCdc25C is

```
                                             (SEQ ID NO: 1900)
  1  caggaagact ctgagtccga cgttggccta cccagtcgga
     aggcagagct gcaatctagt 61  taactacctc ctttccccta gatttccttt cattctgctc
     aagtcttcgc ctgtgtccga 121  tccctatcta ctttctctcc tcttgtagca agcctcagac
     tccaggcttg agctaggttt 181  tgttttctc  ctggtgagaa ttcgaagacc atgtctacgg
     aactcttctc atccacaaga 241  gaggaaggaa gctctggctc aggacccagt tttaggtcta
     atcaaaggaa aatgttaaac 301  ctgctcctgg agagagacac ttcctttacc gtctgtccag
     atgtccctag aactccagtg 361  ggcaaatttc ttggtgattc tgcaaaccta agcattttgt
     ctggaggaac cccaaaatgt 421  tgcctcgatc tttcgaatct tagcagtggg gagataactg
     ccactcagct taccacttct 481  gcagaccttg atgaaactgg tcacctggat tcttcaggac
     ttcaggaagt gcatttagct 541  gggatgaatc atgaccagca cctaatgaaa tgtagcccag
     cacagcttct ttgtagcact 601  ccgaatggtt tggaccgtgg ccatagaaag agagatgcaa
     tgtgtagttc atctgcaaat 661  aaagaaaatg acaatggaaa cttggtggac agtgaaatga
     aatatttggg cagtcccatt 721  actactgttc caaaattgga taaaaatcca aacctaggag
     aagaccaggc agaagagatt
```

```
781  tcagatgaat taatggagtt ttccctgaaa gatcaagaag
     caaaggtgag cagaagtggc 841  ctatatcgct ccccgtcgat gccagagaac ttgaacaggc
     caagactgaa gcaggtggaa 901  aaattcaagg acaacacaat accagataaa gttaaaaaaa
     agtattttc  tggccaagga 961  aagctcagga agggcttatg tttaaagaag acagtctctc
     tgtgtgacat tactatcact
```

```
1021 cagatgctgg aggaagattc taaccagggg cacctgattg
     gtgatttttc caaggtatgt 1081 gcgctgccaa ccgtgtcagg gaaacaccaa gatctgaagt
     atgtcaaccc agaaacagtg 1141 gctgccttac tgtcggggaa gttccagggt ctgattgaga
     agttttatgt cattgattgt 1201 cgctatccat atgagtatct gggaggacac atccagggag
     ccttaaactt atatagtcag 1261 gaagaactgt ttaacttctt tctgaagaag cccatcgtcc
     ctttggacac ccagaagaga 1321 ataatcatcg tgttccactg tgaattctcc tcagagaggg
     gcccccgaat gtgccgctgt 1381 ctgcgtgaag aggacaggtc tctgaaccag tatcctgcat
     tgtactaccc agagctatat 1441 atccttaaag gcggctacag agacttcttt ccagaatata
     tggaactgtg tgaaccacag 1501 agctactgcc ctatgcatca tcaggaccac aagactgagt
     tgctgaggtg tcgaagccag 1561 agcaaagtgc aggaagggga gcggcagctg cgggagcaga
     ttgcccttct ggtgaaggac 1621 atgagccat  gataacattc cagccactgg ctgctaacaa
     gtcaccaaaa agacactgca 1681 gaaaccctga gcagaaagag gccttctgga tggccaaacc
     caagattatt aaaagatgtc 1741 tctgcaaacc aacaggctac caacttgtat ccaggcctgg
     gaatggatta ggtttcagca
```

```
1801 gagctgaaag ctggtggcag agtcctggag ctggctctat
     aaggcagcct tgagttgcat 1861 agagatttgt attggttcag ggaactctgg cattcctttt
     cccaactcct catgtcttct 1921 cacaagccag ccaactcttt ctctctgggc ttcgggctat
     gcaagagcgt tgtctacctt 1981 ctttctttgt attttccttc tttgtttccc cctctttctt
     ttttaaaaat ggaaaaataa 2041 acactacaga atgag
```

The amino acid sequence of human hCdc25C is

```
MSTELFSSTREEGSSGSGPSFRSNQRKMLNLLLERDTSFTVCPD                    (SEQ ID NO: 1901)

VPRTPVGKFLGDSANLSILSGGTPKCCLDLSNLSSGEITATQLTTSADLDETGHLDSS

LQEVHLAGMNHDQHLMKCSPAQLLCSTPNGLDRGHRKRDAMCSSSANKENDNGNLVD

SEMKYLGSPITTVPKLDKNPNLGEDQAEEISDELMEFSLKDQEAKVSRSGLYRSPSMP

ENLNRPRLKQVEKFKDNTIPDKVKKKYFSGQGKLRKGLCLKKTVSLCDITITQMLEED

SNQGHLIGDFSKVCALPTVSGKHQDLKYVNPETVAALLSGKFQGLIEKFYVIDCRYPY

EYLGGHIQGALNLYSQEELFNFFLKKPIVPLDTQKRIIIVFHCEFSSERGPRMCRCLR

EEDRSLNQYPALYYPELYILKGGYRDFFPEYMELCEPQSYCPMHHQDHKTELLRCRSQ

SKVQEGERQLREQIALLVKDMSP
```

See also, e.g., GenBank Accession Nos. NP 001781 (protein) and NM 001790 (nucleic acid, cDNA) and Sadhu (1990) Proc. Natl. Acad. Sci. U.S.A. 87:5139-5143.

Peptides and Polypeptides

The peptides and polypeptides of the invention can be administered to treat cell proliferative disorders, including, e.g., to stop the growth of, or kill, cancer cells. The peptides and polypeptides of the invention can be used to inhibit (e.g., delay) or abrogate G2 cell cycle arrest checkpoint in cells. The peptides and polypeptides of the invention can also be used to inhibit Chk1 and/or Chk2/Cds1 kinase activity.

While the peptides and polypeptides of the invention can be expressed recombinantly in vivo after administration of nucleic acids, as described above, they can also be administered directly, e.g., as a pharmaceutical composition.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention, as defined above, include all "mimetic" and "peptidomimetic" forms.

The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, a mimetic composition is within the scope of the invention if, when administered to or expressed in a cell, it disrupts the G2 cell cycle arrest checkpoint. A mimetic composition can also be within the scope of the invention if it can inhibit Chk1 and/or Chk2/Cds1 kinase activity, or, bind to the active site of either of these enzymes.

Polypeptide mimetic compositions can contain any combination of non-natural structural components, which are typically from three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2, 3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; K- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl) carbodiimide or 1-ethyl-3(4-azonia-4,4-dimetholpentyl) carbodiimide. Aspartyl or glutamyl can also be converted to asparaginyl and glutaminyl residues by reaction with ammonium ions.

Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues.

Arginine residue mimetics can be generated by reacting arginyl with, e.g., one or more conventional reagents, including, e.g., phenylglyoxal, 2,3-butanedione, 1,2-cyclohexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitrobenzenesulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A component of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but which can additionally be referred to as the R- or S-form.

The skilled artisan will recognize that individual synthetic residues and polypeptides incorporating these mimetics can be synthesized using a variety of procedures and methodologies, which are well described in the scientific and patent literature, e.g., Organic Syntheses Collective Volumes, Gilman, et al. (Eds) John Wiley & Sons, Inc., NY. Peptides and peptide mimetics of the invention can also be synthesized using combinatorial methodologies. Various techniques for generation of peptide and peptidomimetic libraries are well known, and include, e.g., multipin, tea bag, and split-couple-mix techniques; see, e.g., al-Obeidi (1998) Mol. Biotechnol. 9:205-223; Hruby (1997) Curr. Opin. Chem. Biol. 1:114-119; Ostergaard (1997) Mol. Divers. 3:17-27; Ostresh (1996) Methods Enzymol. 267:220-234. Modified peptides of the invention can be further produced by chemical modification methods, see, e.g., Belousov (1997) Nucleic Acids Res. 25:3440-3444; Frenkei (1995) Free Radic. Biol. Med. 19:373-380; Blommers (1994) Biochemistry 33:7886-7896.

Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-14). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

The invention provides methods for inhibiting a the activity of a Chk1 kinase or a Chk2 kinase. The invention also provides methods for screening for compositions that inhibit the activity of, or bind to (e.g., bind to the active site), Chk1 kinase and/or a Chk2 kinase. The amino acid sequence of human Chk1 kinase is

```
MAVPFVEDWDLVQTLGEGAYGEVQLAVNRVTEEAVAVKIVDMKR                    (SEQ ID NO: 1902)

AVDCPENIKKEICINKMLNHENVVKFYGHRREGNIQYLFLEYCSGGELFDRIEPDIGM

PEPDAQRFFHQLMAGVVYLHGIGITHRDIKPENLLLDERDNLKISDFGLATVFRYNNR

ERLLNKMCGTLPYVAPELLKRREFHAEPVDVWSCGIVLTAMLAGELPWDQPSDSCQEY

SDWKEKKTYLNPWKKIDSAPLALLHKILVENPSARITIPDIKKDRWYNKPLKKGAKRP

RVTSGGVSESPSGFSKHIQSNLDFSPVNSASSEENVKYSSSQPEPRTGLSLWDTSPSY

IDKLVQGISFSQPTCPDHMLLNSQLLGTPGSSQNPWQRLVKRMTRFFTKLDADKSYQC

LKETCEKLGYQWKKSCMNQVTISTTDRRNNKLIFKVNLLEMDDKILVDFRLSKGDGLE

FKRHFLKIKGKLIDIVSSQKVWLPAT
```

See also, Sanchez (1997) Science 277:1497-1501; Genbank Accession Nos. AF 016582; AAC 51736; NP 001265, NM 001274.

The amino acid sequence of human Chk2 kinase is

```
MSRESDVEAQQSHGSSACSQPHGSVTQSQGSSSQSQGISSSSTS                    (SEQ ID NO: 1903)

MPNSSQSSHSSSGTLSSLETVSTQELYSIPEDQEPEDQEPEEPTPAPWARLWALQDG

FANLECVNDNYWFGRDKSCEYCFDEPLLKRTDKYRTYSKKHFRIFREVGPKNSYIAYI

EDHSGNGTFVNTELVGKGKRRPLNNNSEIALSLSRNKVFVFFDLTVDDQSVYPKALRD

EYIMSKTLGSGACGEVKLAFERKTCKKVAIKIISKRKFAIGSAREADPALNVETEIEI

LKKLNHPCIIKIKNFFDAEDYYIVLELMEGGELFDKVVGNKRLKEATCKLYFYQMLLA

VQYLHENGIIHRDLKPENVLLSSQEEDCLIKITDFGHSKILGETSLMRTLCGTPTYLA

PEVLVSVGTAGYNRAVDCWSLGVILFICLSGYPPFSEHRTQVSLKDQITSGKYNFIPE

VWAEVSEKALDLVKKLLVVDPKARFTTEEALRHPWLQDEDMKRKFQDLLSEENESTAL

PQVLAQPSTSRKRPREGEAEGAETTKRPAVCAAVL
```

See also Brown (1999) Proc. Natl. Acad. Sci. USA 96:3745-3750; Chaturvedi (1999) Oncogene 18:4047-4054; Genbank Accession Nos. NP 009125; NM 007194.

Antibody Generation

The invention provides antibodies that specifically bind to the peptides and polypeptides of the invention. These antibodies can be used to identify the presence of these peptides and polypeptides. The peptides and polypeptides of the invention can be used as immunogens to generate antibodies specific for a corresponding Cdc25C phosphatase. The anti-peptide antibodies of the invention can be used to generate anti-idiotype antibodies that specifically bind to active sites of Chk1 or Chk2 kinase.

Methods of producing polyclonal and monoclonal antibodies are known to those of skill in the art and described in the scientific and patent literature, see, e.g., Coligan, CURRENT PROTOCOLS IN IMMUNOLOGY, Wiley/Greene, N.Y. (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies can be generated in vitro, e.g., using recombinant antibody binding site expressing phage display libraries, in addition to the traditional in vivo methods using animals. See, e.g., Huse (1989) Science 246:1275; Ward (1989) Nature 341:544; Hoogenboom (1997) Trends Biotechnol. 15:62-70; Katz (1997) Annu. Rev. Biophys. Biomol. Struct. 26:27-45. Human antibodies can be generated in mice engineered to produce only human antibodies, as described by, e.g., U.S. Pat. Nos. 5,877,397; 5,874,299; 5,789,650; and 5,939,598. B-cells from these mice can be immortalized using standard techniques (e.g., by fusing with an immortalizing cell line such as a myeloma or by manipulating such B-cells by other techniques to perpetuate a cell line) to produce a monoclonal human antibody-producing cell. See, e.g., U.S. Pat. Nos. 5,916,771; 5,985,615. For making chimeric, e.g., "humanized," antibodies, see e.g., U.S. Pat. Nos. 5,811,522; 5,789,554; 5,861,155. Alternatively, recombinant antibodies can also be expressed by transient or stable expression vectors in mammalian, including human, cells as in Norderhaug (1997) J. Immunol. Methods 204:77-87; Boder (1997) Nat. Biotechnol. 15:553-557; see also U.S. Pat. No. 5,976,833

Screening for Candidate Compounds

The invention provides compositions and methods for screening for potential therapeutic compounds ("candidate compounds") to inhibit or abrogate Chk1 and/or Chk2/Cds1 kinase activity and/or the G2 cell cycle arrest checkpoint. For example, the screening can involve in vitro or in vivo assays wherein Chk1 and Chk2/Cds1 kinases phosphorylate peptides and polypeptides comprising the motifs of the invention; see Example 1, below. Inhibitors of peptide phosphorylation are candidate compounds. Alternatively, assays incorporating the experiments, or variations thereof, as set forth in Example 1, below, can be designed to assay for candidate compounds which can inhibit or abrogate Chk1 and/or Chk2/Cds1 kinase activity and/or the G2 cell cycle arrest checkpoint.

In one embodiment, the peptides and polypeptides of the invention can be bound to a solid support. Solid supports can include, e.g., membranes (e.g., nitrocellulose or nylon), a microtiter dish (e.g., PVC, polypropylene, or polystyrene), a test tube (glass or plastic), a dip stick (e.g., glass, PVC, polypropylene, polystyrene, latex and the like), a microfuge tube, or a glass, silica, plastic, metallic or polymer bead or other substrate such as paper. One solid support uses a metal (e.g., cobalt or nickel)-comprising column which binds with specificity to a histidine tag engineered onto a peptide.

Adhesion of peptides to a solid support can be direct (i.e. the protein contacts the solid support) or indirect (a particular compound or compounds are bound to the support and the target protein binds to this compound rather than the solid support). Peptides can be immobilized either covalently (e.g., utilizing single reactive thiol groups of cysteine residues (see, e.g., Colliuod (1993) Bioconjugate Chem. 4:528-536) or non-covalently but specifically (e.g., via immobilized antibodies (see, e.g., Schuhmann (1991) Adv. Mater. 3:388-391; Lu (1995) Anal. Chem. 67:83-87; the biotin/strepavidin system (see, e.g., Iwane (1997) Biophys. Biochem. Res. Comm. 230: 76-80); metal chelating, e.g., Langmuir-Blodgett films (see, e.g., Ng (1995) Langmuir 11:4048-55); metal-chelating self-assembled monolayers (see, e.g., Sigal (1996) Anal. Chem. 68:490-497) for binding of polyhistidine fusions.

Indirect binding can be achieved using a variety of linkers which are commercially available. The reactive ends can be any of a variety of functionalities including, but not limited to: amino reacting ends such as N-hydroxysuccinimide (NHS) active esters, imidoesters, aldehydes, epoxides, sulfonyl halides, isocyanate, isothiocyanate, and nitroaryl halides; and thiol reacting ends such as pyridyl disulfides, maleimides, thiophthalimides, and active halogens. The heterobifunctional crosslinking reagents have two different reactive ends, e.g., an amino-reactive end and a thiol-reactive end, while homobifunctional reagents have two similar reactive ends, e.g., bismaleimidohexane (BMH) which permits the cross-linking of sulfhydryl-containing compounds. The spacer can be of varying length and be aliphatic or aromatic. Examples of commercially available homobifunctional cross-linking reagents include, but are not limited to, the imidoesters such as dimethyl adipimidate dihydrochloride (DMA); dimethyl pimelimidate dihydrochloride (DMP); and dimethyl suberimidate dihydrochloride (DMS). Heterobifunctional reagents include commercially available active halogen-NHS active esters coupling agents such as N-succinimidyl bromoacetate and N-succinimidyl (4-iodoacetyl)aminobenzoate (SIAB) and the sulfosuccinimidyl derivatives such as sulfosuccinimidyl(4-iodoacetyl)aminobenzoate (sulfo-SIAB) (Pierce). Another group of coupling agents is the heterobifunctional and thiol cleavable agents such as N-succinimidyl 3-(2-pyridyidithio)propionate (SPDP) (Pierce Chemicals, Rockford, Ill.).

Antibodies can be used for binding polypeptides and peptides of the invention to a solid support. This can be done directly by binding peptide-specific antibodies to the column or it can be done by creating fusion protein chimeras comprising motif-containing peptides linked to, e.g., a known epitope (e.g., a tag (e.g., FLAG, myc) or an appropriate immunoglobulin constant domain sequence (an "immunoadhesin," see, e.g., Capon (1989) Nature 377:525-531 (1989).

There are a variety of assay formats that can be used to screen for "candidate compounds" to inhibit or abrogate Chk1 and/or Chk2/Cds1 kinase activity and/or the G2 cell cycle arrest checkpoint. For example, as discussed above, compounds that inhibit the phosphorylation of the motif-comprising peptides of the invention can be candidate compounds. Alternatively, compounds that specifically bind to the motifs of the invention can be candidate compounds. For a general description of different formats for binding assays, see, e.g., BASIC AND CLINICAL IMMUNOLOGY, 7th Ed. (D. Stiles and A. Terr, ed.)(1991); ENZYME IMMUNOASSAY, E. T. Maggio, ed., CRC Press, Boca Raton, Fla. (1980); and "Practice and Theory of Enzyme Immunoassays" in P. Tijssen, LABORATORY TECHNIQUES IN BIOCHEMIS- TRY AND MOLECULAR BIOLOGY, Elsevier Science Publishers, B.V. Amsterdam (1985).

Combinatorial Chemical Libraries

Combinatorial chemical libraries are one means to assist in the generation of new chemical compound leads, i.e., compounds that inhibit Chk1 and/or Chk2/Cds1 kinase and/or inhibit or abrogate the G2 cell cycle arrest checkpoint. A combinatorial chemical library is a collection of diverse chemical compounds generated by either chemical synthesis or biological synthesis by combining a number of chemical "building blocks" such as reagents. For example, a linear combinatorial chemical library such as a polypeptide library is formed by combining a set of chemical building blocks called amino acids in every possible way for a given compound length (i.e., the number of amino acids in a polypeptide compound). Millions of chemical compounds can be synthesized through such combinatorial mixing of chemical building blocks. For example, the systematic, combinatorial mixing of 100 interchangeable chemical building blocks results in the theoretical synthesis of 100 million tetrameric compounds or 10 billion pentameric compounds (see, e.g., Gallop et al. (1994) 37(9): 1233-1250). Preparation and screening of combinatorial chemical libraries are well known to those of skill in the art, see, e.g., U.S. Pat. Nos. 6,004,617; 5,985,356. Such combinatorial chemical libraries include, but are not limited to, peptide libraries (see, e.g., U.S. Pat. No. 5,010,175; Furka (1991) Int. J. Pept. Prot. Res., 37: 487-493, Houghton et al. (1991) Nature, 354: 84-88). Other chemistries for generating chemical diversity libraries include, but are not limited to: peptoids (see, e.g., WO 91/19735), encoded peptides (see, e.g., WO 93/20242), random bio-oligomers (see, e.g., WO 92/00091), benzodiazepines (see, e.g., U.S. Pat. No. 5,288,514), diversomers such as hydantoins, benzodiazepines and dipeptides (see, e.g., Hobbs (1993) Proc. Nat. Acad. Sci. USA 90: 6909-6913), vinylogous polypeptides (see, e.g., Hagihara (1992) J. Amer. Chem. Soc. 114: 6568), non-peptidal peptidomimetics with a Beta-D-Glucose scaffolding (see, e.g., Hirschmann (1992) J. Amer. Chem. Soc. 114: 9217-9218), analogous organic syntheses of small compound libraries (see, e.g., Chen (1994) J. Amer. Chem. Soc. 116: 2661), oligocarbamates (see, e.g., Cho (1993) Science 261:1303), and/or peptidyl phosphonates (see, e.g., Campbell (1994) J. Org. Chem. 59: 658). See also Gordon (1994) J. Med. Chem. 37:1385; for nucleic acid libraries, peptide nucleic acid libraries, see, e.g., U.S. Pat. No. 5,539,083; for antibody libraries, see, e.g., Vaughn (1996) Nature Biotechnology 14:309-314; for carbohydrate libraries, see, e.g., Liang et al. (1996) Science 274: 1520-1522, U.S. Pat. No. 5,593,853; for small organic molecule libraries, see, e.g., for isoprenoids U.S. Pat. No. 5,569,588; for thiazolidinones and metathiazanones, U.S. Pat. No. 5,549,974; for pyrrolidines, U.S. Pat. Nos. 5,525,735 and 5,519,134; for morpholino compounds, U.S. Pat. No. 5,506,337; for benzodiazepines U.S. Pat. No. 5,288,514.

Devices for the preparation of combinatorial libraries are commercially available (see, e.g., U.S. Pat. Nos. 6,045,755; 5,792,431; 357 MPS, 390 MPS, Advanced Chem Tech, Louisville Ky., Symphony, Rainin, Woburn, Mass., 433A Applied Biosystems, Foster City, Calif., 9050 Plus, Millipore, Bedford, Mass.). A number of robotic systems have also been developed for solution phase chemistries. These systems include automated workstations, e.g., like the automated synthesis apparatus developed by Takeda Chemical Industries, LTD. (Osaka, Japan) and many robotic systems utilizing robotic arms (Zymate II, Zymark Corporation, Hopkinton, Mass.; Orca, Hewlett-Packard, Palo Alto, Calif.) which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J., Asinex, Moscow, Ru, Tripos, Inc., St. Louis, Mo., ChemStar, Ltd, Moscow, RU, 3D Pharmaceuticals, Exton, Pa., Martek Biosciences, Columbia, Md., etc.).

Formulation and Administration of Pharmaceutical Compositions

In one embodiment, the peptides and polypeptides of the invention are combined with a pharmaceutically acceptable carrier (excipient) to form a pharmacological composition. Pharmaceutically acceptable carriers can contain a physiologically acceptable compound that acts to, e.g., stabilize, or increase or decrease the absorption or clearance rates of the pharmaceutical compositions of the invention. Physiologically acceptable compounds can include, e.g., carbohydrates, such as glucose, sucrose, or dextrans, antioxidants, such as ascorbic acid or glutathione, chelating agents, low molecular weight proteins, compositions that reduce the clearance or hydrolysis of the peptides or polypeptides, or excipients or other stabilizers and/or buffers. Detergents can also used to stabilize or to increase or decrease the absorption of the pharmaceutical composition, including liposomal carriers. Pharmaceutically acceptable carriers and formulations for peptides and polypeptide are known to the skilled artisan and are described in detail in the scientific and patent literature, see e.g., the latest edition of Remington's Pharmaceutical Science, Mack Publishing Company, Easton, Pa. ("Remington's").

Other physiologically acceptable compounds include wetting agents, emulsifying agents, dispersing agents or preservatives which are particularly useful for preventing the growth or action of microorganisms. Various preservatives are well known and include, e.g., phenol and ascorbic acid. One skilled in the art would appreciate that the choice of a pharmaceutically acceptable carrier including a physiologically acceptable compound depends, for example, on the route of administration of the peptide or polypeptide of the invention and on its particular physio-chemical characteristics.

In one embodiment, a solution of peptide or polypeptide of the invention is dissolved in a pharmaceutically acceptable carrier, e.g., an aqueous carrier if the composition is water-soluble. Examples of aqueous solutions that can be used in formulations for enteral, parenteral or transmucosal drug delivery include, e.g., water, saline, phosphate buffered saline, Hank's solution, Ringer's solution, dextrose/saline, glucose solutions and the like. The formulations can contain pharmaceutically acceptable auxiliary substances as required to approximate physiological conditions, such as buffering agents, tonicity adjusting agents, wetting agents, detergents and the like. Additives can also include additional active ingredients such as bactericidal agents, or stabilizers. For example, the solution can contain sodium acetate, sodium lactate, sodium chloride, potassium chloride, calcium chloride, sorbitan monolaurate or triethanolamine oleate. These compositions can be sterilized by conventional, well-known sterilization techniques, or can be sterile filtered. The resulting aqueous solutions can be packaged for use as is, or lyophilized, the lyophilized preparation being combined with a sterile aqueous solution prior to administration. The concentration of peptide in these formulations can vary widely, and will be selected primarily based on fluid volumes, viscosities, body weight and the like in accordance with the particular mode of administration selected and the patient's needs.

Solid formulations can be used for enteral (oral) administration. They can be formulated as, e.g., pills, tablets, powders or capsules. For solid compositions, conventional nontoxic solid carriers can be used which include, e.g., pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10% to 95% of active ingredient (e.g., peptide). A non-solid formulation can also be used for enteral administration. The carrier can be selected from various oils including those of petroleum, animal, vegetable or synthetic origin, e.g., peanut oil, soybean oil, mineral oil, sesame oil, and the like. Suitable pharmaceutical excipients include e.g., starch, cellulose, talc, glucose, lactose, sucrose, gelatin, malt, rice, flour, chalk, silica gel, magnesium stearate, sodium stearate, glycerol monostearate, sodium chloride, dried skim milk, glycerol, propylene glycol, water, ethanol.

Peptides and polypeptides of the invention, when administered orally, can be protected from digestion. This can be accomplished either by complexing the peptide or polypeptide with a composition to render it resistant to acidic and enzymatic hydrolysis or by packaging the peptide or complex in an appropriately resistant carrier such as a liposome. Means of protecting compounds from digestion are well known in the art, see, e.g., Fix (1996) Pharm Res. 13:1760-1764; Samanen (1996) J. Pharm. Pharmacol. 48:119-135; U.S. Pat. No. 5,391,377, describing lipid compositions for oral delivery of therapeutic agents (liposomal delivery is discussed in further detail, infra).

Systemic administration can also be by transmucosal or transdermal means. For transmucosal or transdermal administration, penetrants appropriate to the barrier to be permeated can be used in the formulation. Such penetrants are generally known in the art, and include, e.g., for transmucosal administration, bile salts and fusidic acid derivatives. In addition, detergents can be used to facilitate permeation. Transmucosal administration can be through nasal sprays or using suppositories. See, e.g., Sayani (1996) "Systemic delivery of peptides and proteins across absorptive mucosae" Crit. Rev. Ther. Drug Carrier Syst. 13:85-184. For topical, transdermal administration, the agents are formulated into ointments, creams, salves, powders and gels. Transdermal delivery systems can also include, e.g., patches.

The peptides and polypeptide complexes can also be administered in sustained delivery or sustained release mechanisms, which can deliver the formulation internally. For example, biodegradeable microspheres or capsules or other biodegradeable polymer configurations capable of sustained delivery of a peptide can be included in the formulations of the invention (see, e.g., Putney (1998) Nat. Biotechnol. 16:153-157).

For inhalation, the peptide or polypeptide can be delivered using any system known in the art, including dry powder aerosols, liquids delivery systems, air jet nebulizers, propellant systems, and the like. See, e.g., Patton (1998) Biotechniques 16:141-143; product and inhalation delivery systems for polypeptide macromolecules by, e.g., Dura Pharmaceuticals (San Diego, Calif.), Aradigm (Hayward, Calif.), Aerogen (Santa Clara, Calif.), Inhale Therapeutic Systems (San Carlos, Calif.), and the like. For example, the pharmaceutical formulation can be administered in the form of an aerosol or mist. For aerosol administration, the formulation can be supplied in finely divided form along with a surfactant and propellant. In another embodiment, the device for delivering the formulation to respiratory tissue is an inhaler in which the formulation vaporizes. Other liquid delivery systems include, e.g., air jet nebulizers.

In preparing pharmaceuticals of the present invention, a variety of formulation modifications can be used and manipulated to alter pharmacokinetics and biodistribution. A number of methods for altering pharmacokinetics and biodistribution are known to one of ordinary skill in the art. Examples of such methods include protection of the complexes in vesicles composed of substances such as proteins, lipids (for example, liposomes, see below), carbohydrates, or synthetic polymers (discussed above). For a general discussion of pharmacokinetics, see, e.g., Remington's, Chapters 37-39.

The peptide and polypeptide complexes used in the methods of the invention can be delivered alone or as pharmaceutical compositions by any means known in the art, e.g., systemically, regionally, or locally (e.g.,.directly into, or directed to, a tumor); by intraarterial, intrathecal (IT), intravenous (IV), parenteral, intra-pleural cavity, topical, oral, or local administration, as subcutaneous, intra-tracheal (e.g., by aerosol) or transmucosal (e.g., buccal, bladder, vaginal, uterine, rectal, nasal mucosa). Actual methods for preparing administrable compositions will be known or apparent to those skilled in the art and are described in detail in the scientific and patent literature, see e.g., Remington's. For a "regional effect," e.g., to focus on a specific organ, one mode of administration includes intra-arterial or intrathecal (IT) injections, e.g., to focus on a specific organ, e.g., brain and CNS (see e.g., Gurun (1997) Anesth Analg. 85:317-323). For example, intra-carotid artery injection if preferred where it is desired to deliver a peptide or polypeptide complex of the invention directly to the brain. Parenteral administration is a preferred route of delivery if a high systemic dosage is needed. Actual methods for preparing parenterally administrable compositions will be known or apparent to those skilled in the art and are described in detail, in e.g., Remington's,. See also, Bai (1997) J. Neuroimmunol. 80:65-75; Warren (1997) J. Neurol. Sci. 152:31-38; Tonegawa (1997) J. Exp. Med. 186:507-515.

In one embodiment, the pharmaceutical formulations comprising peptides or polypeptides of the invention are incorporated in lipid monolayers or bilayers, e.g., liposomes, see, e.g., U.S. Pat. Nos. 6,110,490; 6,096,716; 5,283,185; 5,279,833. The invention also provides formulations in which water soluble peptides or complexes have been attached to the surface of the monolayer or bilayer. For example, peptides can be attached to hydrazide-PEG-(distearoylphosphatidyl) ethanolamine-containing liposomes (see, e.g., Zalipsky (1995) Bioconjug. Chem. 6:705-708). Liposomes or any form of lipid membrane, such as planar lipid membranes or the cell membrane of an intact cell, e.g., a red blood cell, can be used. Liposomal formulations can be by any means, including administration intravenously, transdermally (see, e.g., Vutla (1996) J. Pharm. Sci. 85:5-8), transmucosally, or orally. The invention also provides pharmaceutical preparations in which the peptides and/or complexes of the invention are incorporated within micelles and/or liposomes (see, e.g., Suntres (1994) J. Pharm. Pharmacol. 46:23-28; Woodle (1992) Pharm. Res. 9:260-265). Liposomes and liposomal formulations can be prepared according to standard methods and are also well known in the art, see, e.g., Remington's; Akimaru (1995) Cytokines Mol. Ther. 1:197-210; Alving (1995) Immunol. Rev. 145:5-31; Szoka (1980) Ann. Rev. Biophys. Bioeng. 9:467, U.S. Pat. Nos. 4,235,871, 4,501,728 and 4,837,028.

Treatment Regimens: Pharmacokinetics

The pharmaceutical compositions can be administered in a variety of unit dosage forms depending upon the method of administration. Dosages for typical peptide and polypeptide pharmaceutical compositions are well known to those of skill in the art. Such dosages are typically advisorial in nature and are adjusted depending on the particular therapeutic context, patient tolerance, etc. The amount of peptide or polypeptide adequate to accomplish this is defined as a "therapeutically effective dose." The dosage schedule and amounts effective for this use, i.e., the "dosing regimen," will depend upon a variety of factors, including the stage of the disease or condition, the severity of the disease or condition, the general state of the patient's health, the patient's physical status, age, pharmaceutical formulation and concentration of active agent, and the like. In calculating the dosage regimen for a patient, the mode of administration also is taken into consideration. The dosage regimen must also take into consideration the pharmacokinetics, i.e., the pharmaceutical composition's rate of absorption, bioavailability, metabolism, clearance, and the like. See, e.g., the latest Remington's; Egleton (1997) "Bioavailability and transport of peptides and peptide drugs into the brain" Peptides 18:1431-1439; Langer (1990) Science 249:1527-1533.

In therapeutic applications, compositions are administered to a patient suffering from a cancer in an amount sufficient to at least partially arrest the disease and/or its complications. For example, in one embodiment, a soluble peptide pharmaceutical composition dosage for intravenous (IV) administration would be about 0.01 mg/hr to about 1.0 mg/hr administered over several hours (typically 1, 3, or 6 hours), which can be repeated for weeks with intermittent cycles. Considerably higher dosages (e.g., ranging up to about 10 mg/ml) can be used, particularly when the drug is administered to a secluded site and not into the blood stream, such as into a body cavity or into a lumen of an organ, e.g., the cerebrospinal fluid (CSF).

EXAMPLES

The following examples are offered to illustrate, but not to limit the claimed invention.

Example 1

Administration of Peptides of the Invention to Selectively Sensitize Cancer Cells to DNA Damaging Agents The invention provides compositions and methods for sensitizing cells, particularly cells with an impaired G1 cell cycle arrest checkpoint, such as cancer cells, to DNA damaging agents. The following example describes studies which demonstrate that the compositions and methods of the invention are effective for selectively killing cancer cells (versus normal cells, which have an unimpaired G1 checkpoint). Specifically, these experiments describes the synthesis and use of two exemplary polypeptides of the invention. Two peptides corresponding to amino acids 211 to 221 of human Cdc25C (SEQ ID NO:1) fused with a part of HIV-1-TAT (SEQ ID NO:5). These peptides were demonstrated to inhibit hChk1 kinase (SEQ ID NO:3) and Chk2/HuCds1 (SEQ ID NO:4) kinase activity in vitro and to specifically abrogate the G2 checkpoint in vivo.

Chemicals and reagents. Bleomycin and colchicine were purchased from Wako Pure Chemical Co. (Osaka, Japan). Hydroxyurea was purchased from Sigma Chemical Co. (St. Louis, Mo.). These chemicals were dissolved in distilled $H_2O$ to 10, 5 and 50 mg/ml, respectively, and stored at 4° C. Antibodies against 14-3-3β were purchased from Santa Cruz Biotechnology (Santa Cruz, Calif.) and anti-rabbit IgG horseradish peroxidase-conjugated secondary antibodies were purchased from Amersham Life Sciences (Arlington Heights, Ill.). Antibodies against HA and c-myc, and protein G-Sepharose were purchased from Santa Cruz Biotechnology and Amersham Pharmacia Biotech (Uppsala, Sweden), respectively.

Cell culture and plasmids. A human T-cell leukemia-derived cell line, Jurkat, was cultured in RPMI 1640 (Sigma) supplemented with 10% fetal calf serum. (IBL: Immuno-Biological Laboratories, Gunma, Japan) at 37° C./5% $CO_2$. Human pancreatic epitheloid carcinoma-derived cell lines, MIA PaCa2 and PANC1, were cultured in Eagle's MEM (IWAKI, Chiba, Japan) and Dulbecco's modified Eagle's medium with 4 mM 1-glucose (Sigma) and 1.0 mM sodium pyruvate (Life Technologies, Inc., Grand Island, N.Y.), respectively, and supplemented with 10% fetal calf serum at 37° C./5% $CO_2$. Normal human peripheral blood lymphocytes were collected by Ficoll-Paque (Amersham Pharmacia Biotech) density gradient. Two million cells/ml were cultured in RPMI 1640 supplemented with 10% fetal calf serum at 37° C./5% $CO_2$ in the presence of 5 μg/ml PHA (Life Technologies, Inc.) for a week. Baculovirus lysates that include HA-tagged hChk1 (SEQ ID NO:3) or c-myc-tagged Chk2/HuCds1 (SEQ ID NO:4) and plasmid for GST-Cdc25C (amino, acid 200-256) were made as described in Matsuoka (1998) Science 282:1893-1897, and provided by Dr. Makoto Nakanishi (Department of Biochemistry, Nagoya City University.

Peptides. TAT-S216 peptide was synthesized so that it contained an NH2-terminal 11 amino acid TAT protein transduction domain (YGRKKRRQRRR (SEQ ID NO: 1899); see, e.g., Nagahara (1998) Nature Med. 4:1449-1453) followed by a corresponding amino acid 211 to 221 derived from the human Cdc25C amino acid sequence (SEQ ID NO: 2) (S216; LYRSPSMPENL). Serine-216 residue was changed to alanine in TAT-S216A (S216A; LYRSPAMPENL) (SEQ ID NO: 1897). The Cdc25C portion was partially deleted and substituted with glycine in TAT_Control (GGRSPAMPE) (SEQ ID NO: 1905). All peptides were synthesized by Sawady Technology Co. (Tokyo, Japan).

Purification of recombinant GST-Cdc25C proteins. *Escherichia coli* DH5α cells were transformed by GST-Cdc25C (200-256) plasmid. The cells were incubated with 0.1 mM isopropyl β-D-thiogalactoside for 2 hr, harvested, and lysed with a buffer containing 50 mM Tris HCl (pH8.0), 100 mM NaCl, 0.5% NP-40, 5 μg/ml aprotinin, 5 μg/ml pepstatin A and 5 μg/ml leupeptin. The lysate was sonicated, centrifuged for clarification and incubated with glutathione-Sepharose 4B™ beads for 1 hr at 4° C. and washed five times.

Kinase assay. HA-tagged hChk1 (SEQ ID NO:3) and c-myc-tagged Chk2/HuCds1 (SEQ ID NO:4) expressed in insect cells using recombinant baculovirus (see, e.g., Kaneko (1999) Oncogene 18:3673-3681) were purified by immunoprecipitation using anti-HA or anti-c-myc antibodies and protein G-Sepharose. Immune complex kinase reaction was done in PBS with 1 mM DTT, 1 mM MgCl2 and 100 μCi of [γ-$^{32}$P] ATP (Amersham; 6000 Ci/mmol) plus purified 1 μM GST-Cdc25C or 10 μM Cdc25C peptide (amino acid 211 to 221 of Cdc25C (SEQ ID NO: 2); LYRSPSMPENL, Sawady Technology Co.) substrates at 30° C. for 15 min in the presence of 10 μM TAT-S216, TAT-S216A or TAT-Control. After the reaction, samples were separated in 12% or 15% SDS-PAGE and autoradiographed to detect GST-Cdc25C or peptide phosphorylation.

Cell-cycle analysis. The cell cycle status of the cells treated with peptides and/or bleomycin or colchicine was analyzed by FACS, as described by Kawabe (1997) Nature 385:454-458. In brief, two million Jurkat cells were re-suspended and incubated in 300 µl Krishan's solution (0.1% Sodium citrate, 50 µg/ml PI, 20 µg/ml RNase A and 0.5% NP-40; see supra) for 1 hr at 4° C. and analyzed by FACScan™ (Beckton Dickinson, Mountain View, Calif.) with the program CELLQuest™ (Beckton Dickinson).

Histone H1 kinase assay. Ten million Jurkat cells were treated with hydroxyurea (100 µg/ml), bleomycin (10 µg/ml), or colchicine (5 µg/ml) with or without addition of TAT-S216A, TAT-S216 or TAT-Control (10 µM) for 6 hr. The cells were washed in cold PBS and lysed at 4° c. in 1 ml of buffer A (50 mM Tris pH 8, 2 mM DTT, 5 mM EDTA, 100 mM NaCl, 0.5% NP40, 20 mM Na$_3$V0$_4$, 50 mM NaF, 4 µM Okadaic acid, 5 µg/ml aprotinin, 5 µg/ml pepstatin A and 5 µg/ml leupeptin.). Twenty microliter of p13$^{suc1}$ agarose beads (Upstate Biotechnology., Saranac, N.Y.) were added to the cleared lysates, incubated for 4 hr at 4° C., and washed five times with buffer A without 5 mM EDTA, 20 mM Na$_3$V0$_4$, 50 mM NaF, 4 µM Okadaic acid. Histone HI kinase activity on the beads were analyzed by using Cdc2 kinase assay kit (Upstate Biotechnology) with [γ-$^{32}$P] ATP, followed by 12% SDS-PAGE electrophoresis, and autoradiographed to detect the phosphorylated Histone H1.

Cell cytotoxicity assay. MIA PaCa2 and PANC1 cells (3×10$^3$/well) were plated in 96-well microtiter plates. After an overnight adherence, cells were treated with bleomycin (10 µg/ml) with or without the indicated TAT-peptides at various time points up to 96 hr. Cytotoxicity and cell survival were determined by the 3'-[1-(phenylaminocarbonyl)-3,4-tetrazolium]-bis (4-methoxy-6-nitro) benzene sulfonic acid hydrate) (XTT) assay (Cell Proliferation Kit II™: Boehringer Mannheim, Germany), which was done according to company's protocol and Scudiero (1988) Cancer Res. 48.4827-4833.

TAT-S216 and TAT-S216A Peptides Inhibit hChk1 and Chk2/HuCds1 Kinase Activities

To inhibit hChk1 (SEQ ID NO:3) and Chk2/HuCds1 (SEQ ID NO:4) kinase activities and to abrogate DNA damage-induced-G2 arrest, synthetic peptides comprising amino acid residues 211 to 221 of Cdc25C (SEQ ID NO:1) and a variation of the TAT protein transduction domain (YGRKKRRQRRR (SEQ ID NO: 1899) (TAT-S216) were generated.

The results are shown in FIG. 1: TAT-S216A and TAT-S216 peptides inhibit hChk1 and Chk2/HuCds1 kinase activities in vitro. FIG. 1A. sequences of the peptides. FIG. 1B, in vitro phosphorylation analysis using GST-Cdc25C and purified hChk1. GST-Cdc25C (amino acid 200-256) that was produced in E. coli (DH5α) was used as substrate (1 µM). Immune complex kinase reaction was done in the presence of TAT-S216A (10 µM) or TAT-S216 (10 µM). FIG. 1C, in vitro phosphorylation analysis of hChk1 and Chk2/HuCds1 using synthesized Cdc25C peptide corresponding amino acid 211-221 of Cdc25C (LYRSPSMPENL (SEQ ID NO: 2)) as a substrate (10 µM).

A TAT-S216A peptide (S216A; LYRSPAMPENL, (SEQ ID NO: 1897)), in which serine residue 216 was substituted by alanine was devised to stabilize the transient status of its interaction with hChk1 (SEQ ID NO:3) and Chk2/HuCds1 (SEQ ID NO:4) (FIG. 1A). This TAT peptide was included to efficiently transduce these peptides into cells (see, e.g., Nagahara (1998) supra). This sequence is known to facilitate the uptake of heterologous proteins across the cell membrane. As a control peptide, part of the Cdc25C portion of this peptide was deleted (TAT-Control).

As shown in FIG. 1B, hChk1 (SEQ ID NO:3) was capable of phosphorylating a Cdc25C protein (residues 200-256) (SEQ ID NO:1) fused to GST. Serine-216 on Cdc25C (SEQ ID NO:1) is the major phosphorylation site of this fusion protein in vivo (see, e.g., Furnari (1997) Science 277:1495-1497; Sanchez (1997) Science 277:1497-1501; Peng (1997) Science 277:1501-1505).

In FIG. 1B, both TAT-S216 and TAT-S216A inhibited the phosphorylation of Cdc25C by baculovirus-produced hChk1 (SEQ ID NO:3). TAT-S216 but not TAT-S216A was efficiently phosphorylated by hChk1, suggesting that serine-216 on TAT-S216 was phosphorylated by hChk1 and TAT-S216 would competitively inhibit substrate phosphorylation at excess molar ratio if present in great enough quantity. TAT-Control peptide did not inhibit hChk1 kinase activity.

As shown in FIG. 1C, TAT-S216A significantly inhibited phosphorylation of Cdc25C peptide (residues 200-256) (SEQ ID NO:1) mediated by hChk1 (SEQ ID NO:3) and Chk2/HuCds1 (SEQ ID NO:4) even at a low stoichiometry (at four times more molar excess of TAT-S216A peptide against substrate Cdc25C peptide).

Abrogation of DNA Damage-induced G2 Checkpoint by TAT-S216 and TAT-S216A Peptides The cell cycle status of the cells treated with TAT-S216A or TAT-S216 upon the DNA damage-induced G2 arrest was analyzed by FACS analysis. Histone H1 kinase activities of theses cells were simultaneously monitored. Jurkat cells arrested exclusively at G2 by bleomycin (10 µg/ml) treatment, because it does not have functional p53. Results are shown in FIG. 2: abrogation of DNA damage-induced G2 arrest by TAT-S216A and TAT-S216 peptides. FIG. 2A, FACS analysis of Jurkat cells treated with bleomycin and peptides. Cells were treated with bleomycin (10 µg/ml) with or without peptides (10 µM) for 20 hr. B, histone H1 kinase analysis. Cell lysates were prepared from the cells treated with the indicated reagent for 6 hr. Concentrations used were: hydroxyurea (HU), 100 µg/ml; bleomycin (Bleo), 10 µg/ml; colchicine, 5 µg/ml; TAT-S216A and TAT-S216, 10 µM. C, FACS analysis of colchicine -and peptide-treated cells. Jurkat cells were treated with colchicine (5 µg/ml) with or without peptide (10 µM) for 20 hr.

As shown in FIG. 2A, G2 arrest was completely abrogated by the addition of TAT-S216A or TAT-S216 in response to bleomycin. G2 arrest was abrogated at any time point between 12 and 48 hr by the treatment with TAT-S216A or TAT-S216. Jurkat cells treated with bleomycin together with TAT-Control arrested at G2 similarly to the cells treated with bleomycin alone.

We also observed that either TAT-S216A or TAT-S216 also abrogated G2 arrest induced by gamma-irradiation and cisplatin (gamma-irradiation, 5 Gy; cisplatin, 1 µg/ml for 1 hr treatment). To further analyze the effect of these peptides on G2/M transition, histone H1 kinase activity was monitored. Consistent with the above findings, although histone H1 kinase activity was decreased by the treatment with bleomycin or hydroxyurea, it was unchanged or rather increased by the treatment with bleomycin in the presence of TAT-S216A or TAT-S216 (FIG. 2B). In the presence of TAT-Control peptide, the bleomycin treatment did not affect with H1 kinase activity.

As shown in FIG. 2C, The M-phase arrest of Jurkat cells induced by colchicine was not affected by the addition of TAT-S216 or TAT-S216A. These results demonstrate that TAT-S216A and TAT-S216 specifically abrogated the DNA damage-activated cell cycle G2 checkpoint by inhibiting hChk1 (SEQ ID NO:3) and/or Chk2/HuCds1 (SEQ ID NO:4) kinase activities.

Figure 3:
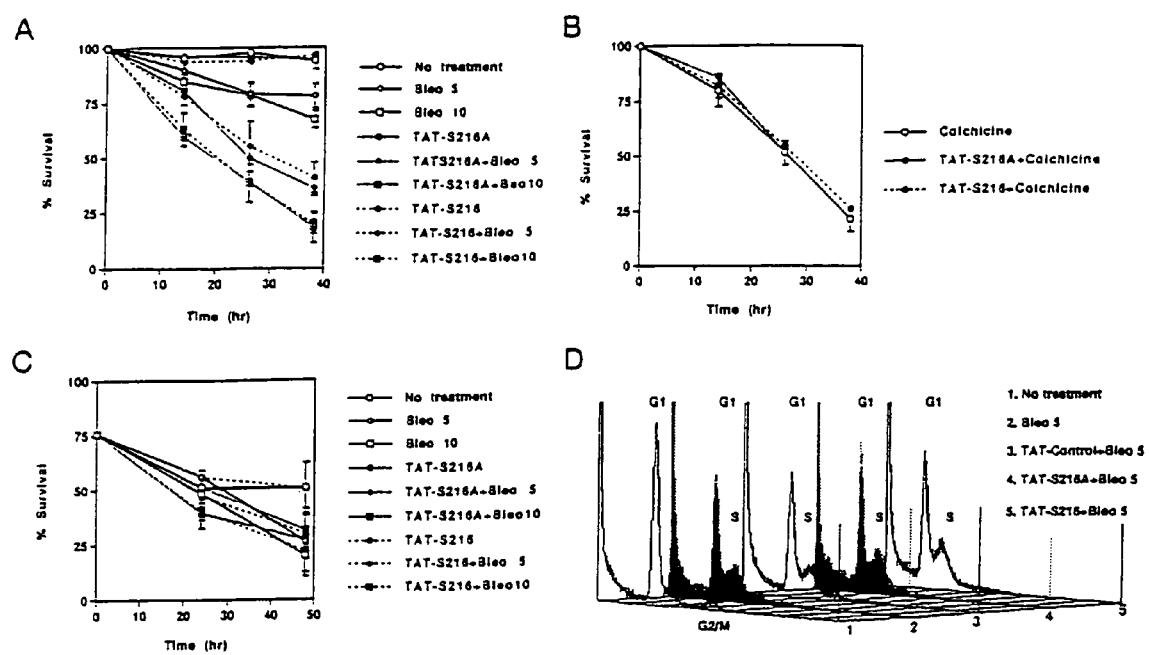
FIG. 3 shows the results of experiments demonstrating that TAT-S216A and TAT-S216 peptides can specifically sensitize cancer cells to bleomycin, but not colchicine.

Sensitization of Jurkat Cells to the Bleomycin-induced Cell Death by TAT-S216A and TAT-S216 Peptides The effect of TAT-S216A and TAT-S216 on the cell death induced by bleomycin was examined. The results are shown in FIG. 3; Trypan blue dye exclusion analysis of Jurkat cells treated with bleomycin (A) or colchicine (B) with or without indicated peptides. Bars, SD Vertical axis, % viability of the cells; Bleo 5, bleomycin 5 µg/ml; Bleo 10, bleomycin 10 µg/ml; colchicine, 5 µg/ml; TAT-S216 or TAT-S216A, 10 µM of indicated peptide. Note that TAT-S216A and TAT-S216 peptides did not increase the cytotoxicity of bleomycin to normal cells. C, survival analysis of PHA blasts treated with bleomycin and peptides. Vertical axis, % viability of the cells determined by trypan blue dye exclusion analysis; horizontal axis, time in hours. Bleo 5, bleomycin 5 µg/ml; Bleo 10, bleomycin 10 µg/ml; TAT-S216 or TAT-S216A, 10 µM of indicated peptide. D, FACS analysis of the cells treated with bleomycin and peptides. PHA-blasts were treated with bleomycin with or without peptides for 20 hr. Vertical axis, cell number; horizontal axis, DNA content indicated by propidium iodide staining.

As shown in FIG. 3A, the addition of TAT-S216A and TAT-S216 efficiently sensitized Jurkat cells to the bleomycin-induced cell death. Whereas bleomycin treatment at 5 or µ10 g/ml killed Jurkat cells by only 27-30%, the addition of 10 µM TAT-216A or TAT-S216 killed Jurkat cells by nearly 80%. In contrast, these peptide by themselves did not show any significant cytotoxicity. In addition, a control peptide TAT-Control did not affect the viability of bleomycin-treated Jurkat cells. Moreover, as expected from the result in FIG. 2C, either TAT-S216A or TAT-S216 did not affect the cytotoxicity by colchicine (FIG. 3B). This observation indicates that the cell death induced by these peptides in the presence of bleomycin was not attributable to a nonspecific cytotoxic effect.

TAT-S216 and TAT-S216A Peptides did not Affect the Viability of Normal Cells

In order to confirm the specificity of the effect of these peptides on cancer cells in which the G1 checkpoint is abrogated; the effect of these peptides on normal human cells was investigated. Mitogen-activated normal human T lymphocytes (PHA blasts) were prepared by stimulating peripheral blood mononuclear cells obtained from a healthy donor with PHA for 1 week. These cells were treated with bleomycin (5 and 10 µg/ml) in the presence or absence of either TAT-S216A or TAT-S216.

As shown in FIG. 3C, these peptides did not augment the cytotoxic effect of bleomycin, although these cells replicated as fast as Jurkat cells. As shown in FIG. 3D, PHA blasts treated with bleomycin (5 µg/ml) arrested at G1 and S phase but not G2, presumably because of the activity of wild-type p53. When these cells were treated with TAT-S216 or TAT-S216A in addition to bleomycin, no further alteration of cell cycle pattern was observed.

Figure 4:
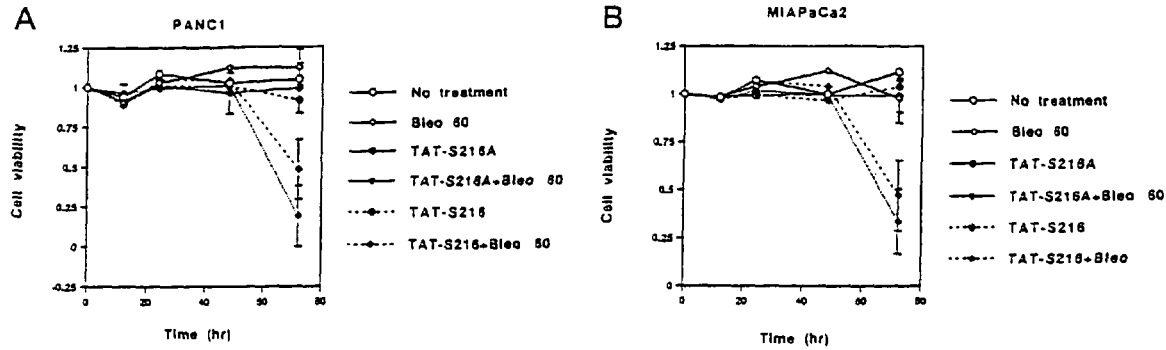
FIG. 4 shows the results of experiments demonstrating that TAT-S216A and TAT-S216 peptides can sensitize cancer cells to bleomycin.

Sensitization of Pancreatic Cancer Cells to the Bleomycin-induced Cell Death by TAT-S216A and TAT-S216 Peptides The effect of these peptides on two other p53-defective pancreatic cancer cell lines, MIA-PaCa2 and PANC1 cells, was examined. FIG. 4 shows the results of survival analysis of PANC1 (A) and MIA PaCa2 (B) cells treated with bleomycin and peptides. PANC1 and MIA PaCa2 cells were treated with bleomycin with or without the indicated peptide. The cell viability was determined by the 3'-[1-(phenylaminocarbonyl)-3,4-tetrazolium]-bis(4-methoxy-6-nitro) benzene sulfonic acid hydrate assay at the indicated times after addition of bleomycin and peptide. Bleo 60, bleomycin 60 µg/ml; TAT-S216 or TAT-S216A, 10 µM of indicated peptide. Bars, SD.

Although these pancreatic cancer cells are known to be resistant to various anti-cancer reagents, these cells could also be sensitized to the bleomycin-induced cell death by TAT-S216A and TAT-S216 (FIG. 4). Similarly, these peptides could sensitize these cells to the cell death induced by other DNA-damaging agents including cisplatin and gamma-irradiation.

In summary, these experiments demonstrated for the first time that short peptides that inhibit both hChk1 and Chk2/HuCds1 kinase activities can specifically abrogate the DNA damage-induced G2 cell growth arrest checkpoint. These data also demonstrated that the specific abrogation of the G2 checkpoint sensitized cancer cells to bleomycin, a DNA-damaging agent, without obvious effect on normal cell cycle and its viability. These observations indicate that these kinases involved in G2 cell cycle checkpoint are ideal targets for the specific abrogation of G2 checkpoint and that the peptides and polypeptides of the invention and their derivatives can be used in novel cancer therapy.

Example 2

Optimization of Sequences for G2 Abrogating Peptides of the Invention

The following example describes studies which identified exemplary G2 checkpoint-abrogating peptides of the invention. This was accomplished by using a computer analysis of the structure of human Chk2 kinase (SEQ ID NO:4) and the peptides of the invention.

Figure 5:
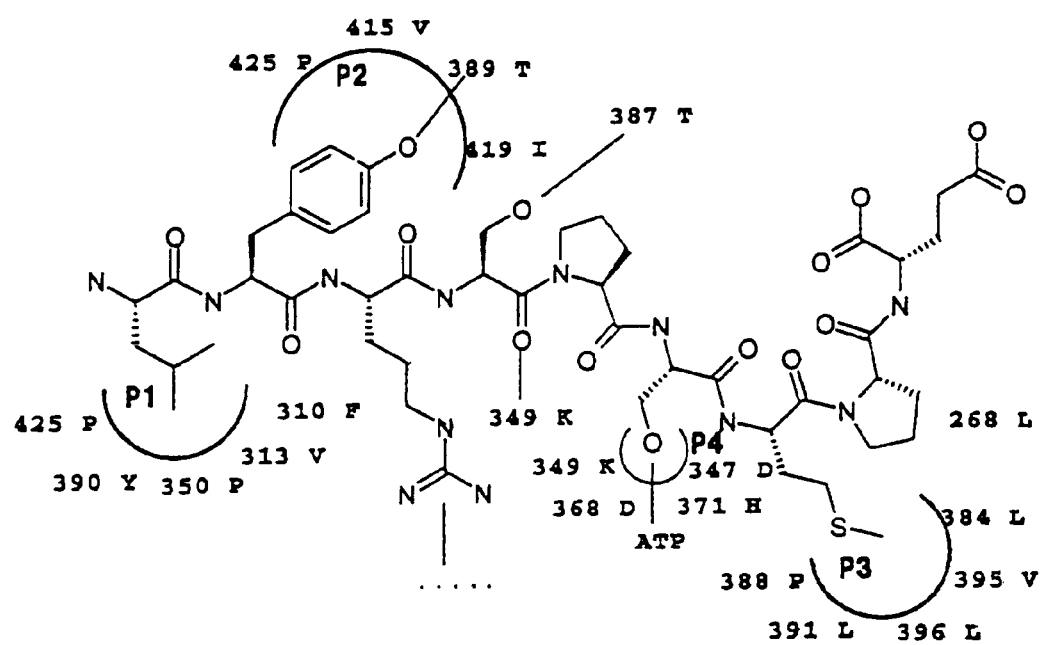
FIG. 5 shows a schematic 3-dimensional structure of human Chk2 interacting with exemplary G2-abrogating peptides of the invention, as described in Example 2, below.

The 3-dimensional structure of human Chk2 was predicted by comparing the primary and 3-D structure of another serine threonine kinase, PKA (PDB protein data base, Research Collaboratory for Structural Bioinformatics (RCSB), The National Science Foundation, Arlington, Va.) (1CDK), using a computer program, MODELER™ (IMMD, Tokyo; Japan). The alignment of the peptides of the invention and hChk2 were predicted by comparing an alignment of hChk1 and various Cdc25C peptides as described by Chen (2000) "The 1.7 A crystal structure of human cell cycle checkpoint kinase Chk1: implications for Chk1 regulation," Cell 100:681-92. By comparing the predicted structure of hChk2 with the peptides of the invention, it was predicted that there are four pockets on hChk2 that are important for the interaction with peptides, as shown in FIG. 5, P1, P2, P3 and P4. The structure of these pockets was used to design and confirm the sequences of exemplary peptides of the invention The ability of these peptides to abrogate the activity of Chk2 kinase, thereby imbuing the ability to abrogate the G2 cell cycle checkpoint, was demonstrated by their ability to act as a phosphorylation substrate for human Chk2 kinase. Exemplary peptides were directly synthesized (immobilized) on a membrane and contacted with human Chk2 kinase. Specifically, oligo-peptides with all sequences predicted by the 3-dimensional model were directly synthesized on a membrane by using an auto-spot-peptide-synthesizer, Model ASP-22 2 (ABiMED, Germany). The amount of peptide was about 0.1 micro-mol/cm$^2$.

The membrane was incubated with 2% Gly-Gly in PBS for 2 hours (hr) at room temperature (RT). Then, they were washed three times with 0.1% Tween-P BS™. The "kination," or "phosphorylation," reaction was performed with a recombinant fusion protein Gst-Chk2 at a concentration of about 5 μg in 4 ml reaction buffer, 1 mM MgCl$_2$, 2% Gly-Gly and γ-$^{33}$P-ATP in PBS at RT for 1 hr. After the reaction, the membrane was washed 5 times with RIPA (1% SDS, 1% NP-40, 100 mM NaCl) and analyzed with a Bass 2500™ image analyzer (Fuji, Japan). The signal was graded to "−," a "+," a "++," or a "+++." Table 1 shows the peptide sequences that gave signals stronger than "++." The peptides RYSLP-PELSNM (SEQ ID NO: 1) and LYRSPSAMPENL (SEQ ID NO: 1906) gave "+" signals by this analysis.

All of the following peptides were phosphorylated by human Chk2 kinase; in position "X" (corresponding to position X$_8$), wherein X=P, F, Y, or W, the signal was strongest (a "+++") when X=the amino acid tyrosine (Y):

```
(SEQ ID NO: 1907)   37-40       LYRSPSHXENL
(SEQ ID NO: 1908)   52-53       LYSSPSYXENL
(SEQ ID NO: 1909)   92-95       LYTSPSYXENL
(SEQ ID NO: 1910)   117-121     LYTSPSHXENL
(SEQ ID NO: 1911)   132-135     LYHSPSYXENL
(SEQ ID NO: 1912)   1127-1130   WYRSPSFXENL
(SEQ ID NO: 1913)   1237-1240   WYTSPSHXENL
(SEQ ID NO: 1914)   372-375     LFTSPSYXENL
(SEQ ID NO: 1915)   637-640     FYSSPSHXENL
(SEQ ID NO: 1916)   642-645     FYTSPSMXENL
(SEQ ID NO: 1917)   648-651     FYTSPSFXENL
(SEQ ID NO: 1918)   652-655     FYTSPSYXENL
(SEQ ID NO: 1919)   1202-1205   WYTSPSMXENL
(SEQ ID NO: 1920)   1207-1210   WYTSPSFXENL
(SEQ ID NO: 1921)   1212-1215   WYTSPSYXENL
```

The best phosphorylation substrates were the peptides L Y R S P S Y Y E N L (SEQ ID NO: 12) and W Y T S P S Y F E N L (SEQ ID NO: 971).

The following Table 1 is a complete list of tested peptides and results of the in vitro phosphorylation by human Chk2 kinase assay. Results are presented to the right of the peptide, below: a "+++" indicates the peptide was relatively highly phosphorylated; a "++" indicates the peptide was relatively less phosphorylated, a "+" indicates the peptide was detectably significantly phosphorylated over negative control, and no indication indicates that a peptide was not significantly phosphorylated over negative control (note: the number immediately to the right of the peptide is the MW of the peptide).

TABLE 1

| # | Peptide | MW | Signal | SEQ ID NO |
|---|---|---|---|---|
| 1 | RYSLPPELSNM | 1308.6 | + | (SEQ ID NO: 1) |
| 2 | LYRSPSMPENL | 1308.6 | + | (SEQ ID NO: 2) |
| 3 | LYRSPSMFENL | 1358.6 | − | (SEQ ID NO: 3) |
| 4 | LYRSPSMYENL | 1374.6 | − | (SEQ ID NO: 4) |
| 5 | LYRSPSMWENL | 1397.7 | − | (SEQ ID NO: 5) |
| 7 | LYRSPSFPENL | 1324.5 | − | (SEQ ID NO: 6) |
| 8 | LYRSPSFFENL | 1374.5 | − | (SEQ ID NO: 7) |
| 9 | LYRSPSFYENL | 1390.5 | − | (SEQ ID NO: 8) |
| 10 | LYRSPSFWENL | 1413.6 | − | (SEQ ID NO: 9) |
| 12 | LYRSPSYPENL | 1340.5 | − | (SEQ ID NO: 10) |
| 13 | LYRSPSYFENL | 1390.5 | + | (SEQ ID NO: 11) |
| 14 | LYRSPSYYENL | 1406.5 | + | (SEQ ID NO: 12) |
| 15 | LYRSPSYWENL | 1429.6 | + | (SEQ ID NO: 13) |

TABLE 1-continued

| # | Peptide | MW | Signal | SEQ ID NO |
|---|---|---|---|---|
| 17 | LYRSPSDPENL | 1292.4 | − | (SEQ ID NO: 14) |
| 18 | LYRSPSDFENL | 1342.4 | − | (SEQ ID NO: 15) |
| 19 | LYRSPSDYENL | 1358.4 | − | (SEQ ID NO: 16) |
| 20 | LYRSPSDWENL | 1381.5 | − | (SEQ ID NO: 17) |
| 22 | LYRSPSEPENL | 1306.4 | − | (SEQ ID NO: 18) |
| 23 | LYRSPSEFENL | 1356.4 | − | (SEQ ID NO: 19) |
| 24 | LYRSPSEYENL | 1372.4 | − | (SEQ ID NO: 20) |
| 25 | LYRSPSEWENL | 1395.5 | − | (SEQ ID NO: 21) |
| 27 | LYRSPSNPENL | 1291.5 | + | (SEQ ID NO: 22) |
| 28 | LYRSPSNFENL | 1341.5 | − | (SEQ ID NO: 23) |
| 29 | LYRSPSNYENL | 1357.5 | + | (SEQ ID NO: 24) |
| 30 | LYRSPSNWENL | 1380.6 | + | (SEQ ID NO: 25) |
| 32 | LYRSPSQPENL | 1305.5 | − | (SEQ ID NO: 26) |
| 33 | LYRSPSQFENL | 1355.5 | − | (SEQ ID NO: 27) |
| 34 | LYRSPSQYENL | 1371.5 | − | (SEQ ID NO: 28) |
| 35 | LYRSPSQWENL | 1394.6 | − | (SEQ ID NO: 29) |
| 37 | LYRSPSHPENL | 1314.5 | + | (SEQ ID NO: 30) |
| 38 | LYRSPSHFENL | 1364.5 | + | (SEQ ID NO: 31) |
| 39 | LYRSPSHYENL | 1380.5 | + | (SEQ ID NO: 32) |
| 40 | LYRSPSHWENL | 1403.6 | + | (SEQ ID NO: 33) |
| 42 | LYSSPSMPENL | 1240.3 | + | (SEQ ID NO: 34) |
| 43 | LYSSPSMFENL | 1290.3 | + | (SEQ ID NO: 35) |
| 44 | LYSSPSMYENL | 1306.3 | + | (SEQ ID NO: 36) |
| 45 | LYSSPSMWENL | 1329.4 | + | (SEQ ID NO: 37) |
| 47 | LYSSPSFPENL | 1256.2 | + | (SEQ ID NO: 38) |
| 48 | LYSSPSFFENL | 1306.2 | + | (SEQ ID NO: 39) |
| 49 | LYSSPSFYENL | 1322.2 | + | (SEQ ID NO: 40) |
| 50 | LYSSPSFWENL | 1345.3 | + | (SEQ ID NO: 41) |
| 52 | LYSSPSYPENL | 1272.2 | + | (SEQ ID NO: 42) |
| 53 | LYSSPSYFENL | 1322.2 | + | (SEQ ID NO: 43) |
| 54 | LYSSPSYYENL | 1338.2 | + | (SEQ ID NO: 44) |
| 55 | LYSSPSYWENL | 1361.3 | + | (SEQ ID NO: 45) |
| 57 | LYSSPSDPENL | 1224.1 | − | (SEQ ID NO: 46) |
| 58 | LYSSPSDFENL | 1274.1 | − | (SEQ ID NO: 47) |
| 59 | LYSSPSDYENL | 1290.1 | − | (SEQ ID NO: 48) |
| 60 | LYSSPSDWENL | 1313.2 | − | (SEQ ID NO: 49) |
| 62 | LYSSPSEPENL | 1238.1 | − | (SEQ ID NO: 50) |
| 63 | LYSSPSEFENL | 1288.1 | − | (SEQ ID NO: 51) |
| 64 | LYSSPSEYENL | 1304.1 | − | (SEQ ID NO: 52) |
| 65 | LYSSPSEWENL | 1327.2 | − | (SEQ ID NO: 53) |
| 67 | LYSSPSNPENL | 1223.2 | − | (SEQ ID NO: 54) |
| 68 | LYSSPSNFENL | 1273.2 | − | (SEQ ID NO: 55) |
| 69 | LYSSPSNYENL | 1289.2 | − | (SEQ ID NO: 56) |
| 70 | LYSSPSNWENL | 1312.3 | − | (SEQ ID NO: 57) |
| 72 | LYSSPSQPENL | 1237.2 | + | (SEQ ID NO: 58) |
| 73 | LYSSPSQFENL | 1287.2 | − | (SEQ ID NO: 59) |
| 74 | LYSSPSQYENL | 1303.2 | − | (SEQ ID NO: 60) |
| 75 | LYSSPSQWENL | 1326.3 | + | (SEQ ID NO: 61) |
| 77 | LYSSPSHPENL | 1246.2 | ++ | (SEQ ID NO: 62) |
| 78 | LYSSPSHFENL | 1296.2 | ++ | (SEQ ID NO: 63) |
| 79 | LYSSPSHYENL | 1312.2 | ++ | (SEQ ID NO: 64) |
| 80 | LYSSPSHWENL | 1335.3 | ++ | (SEQ ID NO: 65) |
| 82 | LYTSPSMPENL | 1253.5 | ++ | (SEQ ID NO: 66) |
| 83 | LYTSPSMFENL | 1303.5 | ++ | (SEQ ID NO: 67) |
| 84 | LYTSPSMYENL | 1319.5 | ++ | (SEQ ID NO: 68) |
| 85 | LYTSPSMWENL | 1342.6 | ++ | (SEQ ID NO: 69) |
| 87 | LYTSPSFPENL | 1269.4 | ++ | (SEQ ID NO: 70) |
| 88 | LYTSPSFFENL | 1319.4 | ++ | (SEQ ID NO: 71) |
| 89 | LYTSPSFYENL | 1335.4 | ++ | (SEQ ID NO: 72) |
| 90 | LYTSPSFWENL | 1358.5 | ++ | (SEQ ID NO: 73) |
| 92 | LYTSPSYPENL | 1285.4 | ++ | (SEQ ID NO: 74) |
| 93 | LYTSPSYFENL | 1335.4 | ++ | (SEQ ID NO: 75) |
| 94 | LYTSPSYYENL | 1351.4 | +++ | (SEQ ID NO: 76) |
| 95 | LYTSPSYWENL | 1374.5 | ++ | (SEQ ID NO: 77) |
| 97 | LYTSPSDPENL | 1237.3 | − | (SEQ ID NO: 78) |
| 98 | LYTSPSDFENL | 1287.3 | − | (SEQ ID NO: 79) |
| 99 | LYTSPSDYENL | 1303.3 | − | (SEQ ID NO: 80) |
| 100 | LYTSPSDWENL | 1326.4 | − | (SEQ ID NO: 81) |
| 102 | LYTSPSEPENL | 1251.3 | − | (SEQ ID NO: 82) |
| 103 | LYTSPSEFENL | 1301.3 | − | (SEQ ID NO: 83) |
| 104 | LYTSPSEYENL | 1317.3 | − | (SEQ ID NO: 84) |
| 105 | LYTSPSEWENL | 1340.4 | − | (SEQ ID NO: 85) |
| 107 | LYTSPSNPENL | 1236.4 | + | (SEQ ID NO: 86) |
| 108 | LYTSPSNFENL | 1286.4 | + | (SEQ ID NO: 87) |
| 109 | LYTSPSNYENL | 1302.4 | + | (SEQ ID NO: 88) |
| 110 | LYTSPSNWENL | 1325.5 | + | (SEQ ID NO: 89) |
| 112 | LYTSPSQPENL | 1250.4 | − | (SEQ ID NO: 90) |
| 113 | LYTSPSQFENL | 1300.4 | − | (SEQ ID NO: 91) |
| 114 | LYTSPSQYENL | 1316.4 | − | (SEQ ID NO: 92) |

TABLE 1-continued

| | | | | | |
|---|---|---|---|---|---|
| 115 | LYTSPSQWENL | 1339.5 | − | (SEQ ID NO: | 93) |
| 117 | LYTSPSHPENL | 1259.4 | + | (SEQ ID NO: | 94) |
| 118 | LYTSPSHFENL | 1309.4 | + | (SEQ ID NO: | 95) |
| 119 | LYTSPSHYENL | 1325.4 | + | (SEQ ID NO: | 96) |
| 120 | LYTSPSHWENL | 1348.5 | + | (SEQ ID NO: | 97) |
| 122 | LYHSPSMPENL | 1289.6 | − | (SEQ ID NO: | 98) |
| 123 | LYHSPSMFENL | 1339.6 | − | (SEQ ID NO: | 99) |
| 124 | LYHSPSMYENL | 1355.6 | − | (SEQ ID NO: | 100) |
| 125 | LYHSPSMWENL | 1378.7 | − | (SEQ ID NO: | 101) |
| 127 | LYHSPSFPENL | 1305.5 | − | (SEQ ID NO: | 102) |
| 128 | LYHSPSFFENL | 1355.5 | − | (SEQ ID NO: | 103) |
| 129 | LYHSPSFYENL | 1371.5 | − | (SEQ ID NO: | 104) |
| 130 | LYHSPSFWENL | 1394.6 | − | (SEQ ID NO: | 105) |
| 132 | LYHSPSYPENL | 1321.5 | + | (SEQ ID NO: | 106) |
| 133 | LYHSPSYFENL | 1371.5 | + | (SEQ ID NO: | 107) |
| 134 | LYHSPSYYENL | 1387.5 | +++ | (SEQ ID NO: | 108) |
| 135 | LYHSPSYWENL | 1410.6 | + | (SEQ ID NO: | 109) |
| 137 | LYHSPSDPENL | 1273.4 | − | (SEQ ID NO: | 110) |
| 138 | LYHSPSDFENL | 1323.4 | − | (SEQ ID NO: | 111) |
| 139 | LYHSPSDYENL | 1339.4 | − | (SEQ ID NO: | 112) |
| 140 | LYHSPSDWENL | 1362.5 | − | (SEQ ID NO: | 113) |
| 142 | LYHSPSEPENL | 1287.4 | − | (SEQ ID NO: | 114) |
| 143 | LYHSPSEFENL | 1337.4 | − | (SEQ ID NO: | 115) |
| 144 | LYHSPSEYENL | 1353.4 | − | (SEQ ID NO: | 116) |
| 145 | LYHSPSEWENL | 1376.5 | − | (SEQ ID NO: | 117) |
| 147 | LYHSPSNPENL | 1272.5 | − | (SEQ ID NO: | 118) |
| 148 | LYHSPSNFENL | 1322.5 | − | (SEQ ID NO: | 119) |
| 149 | LYHSPSNYENL | 1338.5 | − | (SEQ ID NO: | 120) |
| 150 | LYHSPSNWENL | 1361.6 | − | (SEQ ID NO: | 121) |
| 152 | LYHSPSQPENL | 1286.5 | − | (SEQ ID NO: | 122) |
| 153 | LYHSPSQFENL | 1336.5 | − | (SEQ ID NO: | 123) |
| 154 | LYHSPSQYENL | 1352.5 | − | (SEQ ID NO: | 124) |
| 155 | LYHSPSQWENL | 1375.6 | − | (SEQ ID NO: | 125) |
| 157 | LYHSPSHPENL | 1295.5 | − | (SEQ ID NO: | 126) |
| 158 | LYHSPSHFENL | 1345.5 | − | (SEQ ID NO: | 127) |
| 159 | LYHSPSHYENL | 1361.5 | − | (SEQ ID NO: | 128) |
| 160 | LYHSPSHWENL | 1384.6 | − | (SEQ ID NO: | 129) |
| 162 | LYNSPSMPENL | 1266.6 | − | (SEQ ID NO: | 130) |
| 163 | LYNSPSMFENL | 1316.6 | − | (SEQ ID NO: | 131) |
| 164 | LYNSPSMYENL | 1332.6 | − | (SEQ ID NO: | 132) |
| 165 | LYNSPSMWENL | 1355.7 | − | (SEQ ID NO: | 133) |
| 167 | LYNSPSFPENL | 1282.5 | − | (SEQ ID NO: | 134) |
| 168 | LYNSPSFFENL | 1332.5 | − | (SEQ ID NO: | 135) |
| 169 | LYNSPSFYENL | 1348.5 | − | (SEQ ID NO: | 136) |
| 170 | LYNSPSFWENL | 1371.6 | − | (SEQ ID NO: | 137) |
| 172 | LYNSPSYPENL | 1298.5 | − | (SEQ ID NO: | 138) |
| 173 | LYNSPSYFENL | 1348.5 | − | (SEQ ID NO: | 139) |
| 174 | LYNSPSYYENL | 1364.5 | − | (SEQ ID NO: | 140) |
| 175 | LYNSPSYWENL | 1387.6 | − | (SEQ ID NO: | 141) |
| 177 | LYNSPSDPENL | 1250.4 | − | (SEQ ID NO: | 142) |
| 178 | LYNSPSDFENL | 1300.4 | − | (SEQ ID NO: | 143) |
| 179 | LYNSPSDYENL | 1316.4 | − | (SEQ ID NO: | 144) |
| 180 | LYNSPSDWENL | 1339.5 | − | (SEQ ID NO: | 145) |
| 182 | LYNSPSEPENL | 1264.4 | − | (SEQ ID NO: | 146) |
| 183 | LYNSFSEFENL | 1314.4 | − | (SEQ ID NO: | 147) |
| 184 | LYNSPSEYENL | 1330.4 | − | (SEQ ID NO: | 148) |
| 185 | LYNSPSEWENL | 1353.5 | − | (SEQ ID NO: | 149) |
| 187 | LYNSPSNPENL | 1249.5 | − | (SEQ ID NO: | 150) |
| 188 | LYNSPSNFENL | 1299.5 | − | (SEQ ID NO: | 151) |
| 189 | LYNSPSNYENL | 1315.5 | − | (SEQ ID NO: | 152) |
| 190 | LYNSPSNWENL | 1338.6 | − | (SEQ ID NO: | 153) |
| 192 | LYNSPSQPENL | 1263.5 | − | (SEQ ID NO: | 154) |
| 193 | LYNSPSQFENL | 1313.5 | − | (SEQ ID NO: | 155) |
| 194 | LYNSPSQYENL | 1329.5 | − | (SEQ ID NO: | 156) |
| 195 | LYNSPSQWENL | 1352.6 | − | (SEQ ID NO: | 157) |
| 197 | LYNSPSHPENL | 1272.5 | − | (SEQ ID NO: | 158) |
| 198 | LYNSPSHFENL | 1322.5 | − | (SEQ ID NO: | 159) |
| 199 | LYNSPSHYENL | 1338.5 | − | (SEQ ID NO: | 160) |
| 200 | LYNSFSHWENL | 1361.6 | − | (SEQ ID NO: | 161) |
| 202 | LYGSPSMPENL | 1209.5 | − | (SEQ ID NO: | 162) |
| 203 | LYGSPSMFENL | 1259.5 | − | (SEQ ID NO: | 163) |
| 204 | LYGSPSMYENL | 1275.5 | − | (SEQ ID NO: | 164) |
| 205 | LYGSPSMWENL | 1298.6 | − | (SEQ ID NO: | 165) |
| 207 | LYGSPSFPENL | 1225.4 | − | (SEQ ID NO: | 166) |
| 208 | LYGSPSFFENL | 1275.4 | − | (SEQ ID NO: | 167) |
| 209 | LYGSPSFYENL | 1291.4 | − | (SEQ ID NO: | 168) |
| 210 | LYGSPSFWENL | 1314.5 | − | (SEQ ID NO: | 169) |
| 212 | LYGSPSYPENL | 1241.4 | − | (SEQ ID NO: | 170) |
| 213 | LYGSPSYFENL | 1291.4 | − | (SEQ ID NO: | 171) |
| 214 | LYGSPSYYENL | 1307.4 | − | (SEQ ID NO: | 172) |
| 215 | LYGSPSYWENL | 1330.5 | − | (SEQ ID NO: | 173) |
| 217 | LYGSPSDPENL | 1193.3 | − | (SEQ ID NO: | 174) |
| 218 | LYGSPSDFENL | 1243.3 | − | (SEQ ID NO: | 175) |
| 219 | LYGSPSDYENL | 1259.3 | − | (SEQ ID NO: | 176) |
| 220 | LYGSPSDWENL | 1282.4 | − | (SEQ ID NO: | 177) |
| 222 | LYGSPSEPENL | 1207.3 | − | (SEQ ID NO: | 178) |
| 223 | LYGSPSEFENL | 1257.3 | − | (SEQ ID NO: | 179) |
| 224 | LYGSPSEYENL | 1273.3 | − | (SEQ ID NO: | 180) |
| 225 | LYGSPSEWENL | 1296.4 | − | (SEQ ID NO: | 181) |
| 227 | LYGSPSNPENL | 1192.4 | − | (SEQ ID NO: | 182) |
| 228 | LYGSPSNFENL | 1242.4 | − | (SEQ ID NO: | 183) |
| 229 | LYGSPSNYENL | 1258.4 | − | (SEQ ID NO: | 184) |
| 230 | LYGSPSNWENL | 1281.5 | − | (SEQ ID NO: | 185) |
| 232 | LYGSPSQPENL | 1206.4 | − | (SEQ ID NO: | 186) |
| 233 | LYGSPSQFENL | 1256.4 | − | (SEQ ID NO: | 187) |
| 234 | LYGSPSQYENL | 1272.4 | − | (SEQ ID NO: | 188) |
| 235 | LYGSPSQWENL | 1295.5 | − | (SEQ ID NO: | 189) |
| 237 | LYGSPSHPENL | 1215.4 | − | (SEQ ID NO: | 190) |
| 238 | LYGSPSHFENL | 1265.4 | − | (SEQ ID NO: | 191) |
| 239 | LYGSPSHYENL | 1281.4 | − | (SEQ ID NO: | 192) |
| 240 | LYGSPSHWENL | 1304.5 | − | (SEQ ID NO: | 193) |
| 242 | LYASPSMPENL | 1223.5 | − | (SEQ ID NO: | 194) |
| 243 | LYASPSMFENL | 1273.5 | − | (SEQ ID NO: | 195) |
| 244 | LYASPSMYENL | 1289.5 | − | (SEQ ID NO: | 196) |
| 245 | LYASPSMWENL | 1312.6 | − | (SEQ ID NO: | 197) |
| 247 | LYASPSFPENL | 1239.4 | − | (SEQ ID NO: | 198) |
| 248 | LYASPSFFENL | 1289.4 | − | (SEQ ID NO: | 199) |
| 249 | LYASPSFYENL | 1305.4 | − | (SEQ ID NO: | 200) |
| 250 | LYASPSFWENL | 1328.5 | − | (SEQ ID NO: | 201) |
| 252 | LYASPSYPENL | 1255.4 | − | (SEQ ID NO: | 202) |
| 253 | LYASPSYFENL | 1305.4 | − | (SEQ ID NO: | 203) |
| 254 | LYASPSYYENL | 1321.4 | − | (SEQ ID NO: | 204) |
| 255 | LYASPSYWENL | 1344.5 | − | (SEQ ID NO: | 205) |
| 257 | LYASPSDPENL | 1207.3 | − | (SEQ ID NO: | 206) |
| 258 | LYASPSDFENL | 1257.3 | − | (SEQ ID NO: | 207) |
| 259 | LYASPSDYENL | 1273.3 | − | (SEQ ID NO: | 208) |
| 260 | LYASPSDWENL | 1296.4 | − | (SEQ ID NO: | 209) |
| 262 | LYASPSEPENL | 1221.3 | − | (SEQ ID NO: | 210) |
| 263 | LYASPSEFENL | 1271.3 | − | (SEQ ID NO: | 211) |
| 264 | LYASPSEYENL | 1287.3 | − | (SEQ ID NO: | 212) |
| 265 | LYASPSEWENL | 1310.4 | − | (SEQ ID NO: | 213) |
| 267 | LYASPSNPENL | 1206.4 | − | (SEQ ID NO: | 214) |
| 268 | LYASPSNFENL | 1256.4 | − | (SEQ ID NO: | 215) |
| 269 | LYASPSNYENL | 1272.4 | − | (SEQ ID NO: | 216) |
| 270 | LYASPSNWENL | 1295.5 | − | (SEQ ID NO: | 217) |
| 272 | LYASPSQPENL | 1220.4 | − | (SEQ ID NO: | 218) |
| 273 | LYASPSQFENL | 1270.4 | − | (SEQ ID NO: | 219) |
| 274 | LYASPSQYENL | 1286.4 | − | (SEQ ID NO: | 220) |
| 275 | LYASPSQWENL | 1309.5 | − | (SEQ ID NO: | 221) |
| 277 | LYASPSHPENL | 1229.4 | − | (SEQ ID NO: | 222) |
| 278 | LYASPSHFENL | 1279.4 | − | (SEQ ID NO: | 223) |
| 279 | LYASPSHYENL | 1295.4 | − | (SEQ ID NO: | 224) |
| 280 | LYASPSHWENL | 1318.5 | − | (SEQ ID NO: | 225) |
| 282 | LFRSPSMPENL | 1292.6 | − | (SEQ ID NO: | 226) |
| 283 | LFRSPSMFENL | 1342.6 | − | (SEQ ID NO: | 227) |
| 284 | LFRSPSMYENL | 1358.6 | − | (SEQ ID NO: | 228) |
| 285 | LFRSPSMWENL | 1381.7 | − | (SEQ ID NO: | 229) |
| 287 | LFRSPSFPENL | 1308.5 | − | (SEQ ID NO: | 230) |
| 288 | LFRSPSFFENL | 1358.5 | − | (SEQ ID NO: | 231) |
| 289 | LFRSPSFYENL | 1374.5 | − | (SEQ ID NO: | 232) |
| 290 | LFRSPSFWENL | 1397.6 | − | (SEQ ID NO: | 233) |
| 292 | LFRSPSYPENL | 1324.5 | − | (SEQ ID NO: | 234) |
| 293 | LFRSPSYFENL | 1374.5 | − | (SEQ ID NO: | 235) |
| 294 | LFRSPSYYENL | 1390.5 | − | (SEQ ID NO: | 236) |
| 295 | LFRSPSYWENL | 1413.6 | − | (SEQ ID NO: | 237) |
| 297 | LFRSPSDPENL | 1276.4 | − | (SEQ ID NO: | 238) |
| 298 | LFRSPSDFENL | 1326.4 | − | (SEQ ID NO: | 239) |
| 299 | LFRSPSDYENL | 1342.4 | − | (SEQ ID NO: | 240) |
| 300 | LFRSPSDWENL | 1365.5 | − | (SEQ ID NO: | 241) |
| 302 | LFRSPSEPENL | 1290.4 | − | (SEQ ID NO: | 242) |
| 303 | LFRSPSEFENL | 1340.4 | − | (SEQ ID NO: | 243) |
| 304 | LFRSPSEYENL | 1356.4 | − | (SEQ ID NO: | 244) |
| 305 | LFRSPSEWENL | 1379.5 | − | (SEQ ID NO: | 245) |
| 307 | LFRSPSNPENL | 1275.5 | − | (SEQ ID NO: | 246) |
| 308 | LFRSPSNFENL | 1325.5 | − | (SEQ ID NO: | 247) |
| 309 | LFRSPSNYENL | 1341.5 | − | (SEQ ID NO: | 248) |
| 310 | LFRSPSNWENL | 1364.6 | − | (SEQ ID NO: | 249) |
| 312 | LFRSPSQPENL | 1289.5 | − | (SEQ ID NO: | 250) |

TABLE 1-continued

| | | | | |
|---|---|---|---|---|
| 313 | LFRSPSQFENL | 1339.5 | − | (SEQ ID NO: 251) |
| 314 | LFRSPSQYENL | 1355.5 | − | (SEQ ID NO: 252) |
| 315 | LFRSPSQWENL | 1378.6 | − | (SEQ ID NO: 253) |
| 317 | LFRSPSHPENL | 1298.5 | − | (SEQ ID NO: 254) |
| 318 | LFRSPSHFENL | 1348.5 | − | (SEQ ID NO: 255) |
| 319 | LFRSPSHYENL | 1364.5 | − | (SEQ ID NO: 256) |
| 320 | LFRSPSHWENL | 1387.6 | − | (SEQ ID NO: 257) |
| 322 | LFSSPSMPENL | 1224.3 | − | (SEQ ID NO: 258) |
| 323 | LFSSPSMFENL | 1274.3 | − | (SEQ ID NO: 259) |
| 324 | LFSSPSMYENL | 1290.3 | − | (SEQ ID NO: 260) |
| 325 | LFSSPSMWENL | 1313.4 | − | (SEQ ID NO: 261) |
| 327 | LFSSPSFPENL | 1240.2 | − | (SEQ ID NO: 262) |
| 328 | LFSSPSFFENL | 1290.2 | − | (SEQ ID NO: 263) |
| 329 | LFSSPSFYENL | 1306.2 | − | (SEQ ID NO: 264) |
| 330 | LFSSPSFWENL | 1329.3 | − | (SEQ ID NO: 265) |
| 332 | LFSSPSYPENL | 1256.2 | − | (SEQ ID NO: 266) |
| 333 | LFSSPSYFENL | 1306.2 | − | (SEQ ID NO: 267) |
| 334 | LFSSPSYYENL | 1322.2 | − | (SEQ ID NO: 268) |
| 335 | LFSSPSYWENL | 1345.3 | − | (SEQ ID NO: 269) |
| 337 | LFSSPSDPENL | 1208.1 | − | (SEQ ID NO: 270) |
| 338 | LFSSPSDFENL | 1258.1 | − | (SEQ ID NO: 271) |
| 339 | LFSSPSDYENL | 1274.1 | − | (SEQ ID NO: 272) |
| 340 | LFSSPSDWENL | 1297.2 | − | (SEQ ID NO: 273) |
| 342 | LFSSPSEPENL | 1222.1 | − | (SEQ ID NO: 274) |
| 343 | LFSSPSEFENL | 1272.1 | − | (SEQ ID NO: 275) |
| 344 | LFSSPSEYENL | 1288.1 | − | (SEQ ID NO: 276) |
| 345 | LFSSPSEWENL | 1311.2 | − | (SEQ ID NO: 277) |
| 347 | LFSSPSNPENL | 1207.2 | − | (SEQ ID NO: 278) |
| 348 | LFSSPSNFENL | 1257.2 | − | (SEQ ID NO: 279) |
| 349 | LFSSPSNYENL | 1273.2 | − | (SEQ ID NO: 280) |
| 350 | LFSSPSNWENL | 1296.3 | − | (SEQ ID NO: 281) |
| 352 | LFSSPSQPENL | 1221.2 | − | (SEQ ID NO: 282) |
| 353 | LFSSPSQFENL | 1271.2 | − | (SEQ ID NO: 283) |
| 354 | LFSSPSQYENL | 1287.2 | − | (SEQ ID NO: 284) |
| 355 | LFSSPSQWENL | 1310.3 | − | (SEQ ID NO: 285) |
| 357 | LFSSPSHPENL | 1230.2 | − | (SEQ ID NO: 286) |
| 358 | LFSSPSHFENL | 1280.2 | − | (SEQ ID NO: 287) |
| 359 | LFSSPSHYENL | 1296.2 | − | (SEQ ID NO: 288) |
| 360 | LFSSPSHWENL | 1319.3 | − | (SEQ ID NO: 289) |
| 362 | LFTSPSMPENL | 1237.5 | − | (SEQ ID NO: 290) |
| 363 | LFTSPSMFENL | 1287.5 | − | (SEQ ID NO: 291) |
| 364 | LFTSPSMYENL | 1303.5 | − | (SEQ ID NO: 292) |
| 365 | LFTSPSMWENL | 1326.6 | − | (SEQ ID NO: 293) |
| 367 | LFTSPSFPENL | 1253.4 | − | (SEQ ID NO: 294) |
| 368 | LFTSPSFFENL | 1303.4 | − | (SEQ ID NO: 295) |
| 369 | LFTSPSFYENL | 1319.4 | − | (SEQ ID NO: 296) |
| 370 | LFTSPSFWENL | 1342.5 | − | (SEQ ID NO: 297) |
| 372 | LFTSPSYPENL | 1269.4 | + | (SEQ ID NO: 298) |
| 373 | LFTSPSYFENL | 1319.4 | + | (SEQ ID NO: 299) |
| 374 | LFTSPSYYENL | 1335.4 | +++ | (SEQ ID NO: 300) |
| 375 | LFTSPSYWENL | 1358.5 | + | (SEQ ID NO: 301) |
| 377 | LFTSPSDPENL | 1221.3 | − | (SEQ ID NO: 302) |
| 378 | LFTSPSDFENL | 1271.3 | − | (SEQ ID NO: 303) |
| 379 | LFTSPSDYENL | 1287.3 | − | (SEQ ID NO: 304) |
| 380 | LFTSPSDWENL | 1310.4 | − | (SEQ ID NO: 305) |
| 382 | LFTSPSEPENL | 1235.3 | − | (SEQ ID NO: 306) |
| 383 | LFTSPSEFENL | 1285.3 | − | (SEQ ID NO: 307) |
| 384 | LFTSPSEYENL | 1301.3 | − | (SEQ ID NO: 308) |
| 385 | LFTSPSEWENL | 1324.4 | − | (SEQ ID NO: 309) |
| 387 | LFTSPSNPENL | 1220.4 | − | (SEQ ID NO: 310) |
| 388 | LFTSPSNFENL | 1270.4 | − | (SEQ ID NO: 311) |
| 389 | LFTSPSNYENL | 1286.4 | − | (SEQ ID NO: 312) |
| 390 | LFTSPSNWENL | 1309.5 | − | (SEQ ID NO: 313) |
| 392 | LFTSPSQPENL | 1234.4 | − | (SEQ ID NO: 314) |
| 393 | LFTSPSQFENL | 1284.4 | − | (SEQ ID NO: 315) |
| 394 | LFTSPSQYENL | 1300.4 | − | (SEQ ID NO: 316) |
| 395 | LFTSPSQWENL | 1323.5 | − | (SEQ ID NO: 317) |
| 397 | LFTSPSHPENL | 1243.4 | − | (SEQ ID NO: 318) |
| 398 | LFTSPSHFENL | 1293.4 | − | (SEQ ID NO: 319) |
| 399 | LFTSPSHYENL | 1309.4 | − | (SEQ ID NO: 320) |
| 400 | LFTSPSHWENL | 1332.5 | − | (SEQ ID NO: 321) |
| 402 | LFHSPSMPENL | 1273.6 | − | (SEQ ID NO: 322) |
| 403 | LFHSPSMFENL | 1323.6 | − | (SEQ ID NO: 323) |
| 404 | LFHSPSMYENL | 1339.6 | − | (SEQ ID NO: 324) |
| 405 | LFHSPSMWENL | 1362.7 | − | (SEQ ID NO: 325) |
| 407 | LFHSPSFPENL | 1289.5 | − | (SEQ ID NO: 326) |
| 408 | LFHSPSFFENL | 1339.5 | − | (SEQ ID NO: 327) |
| 409 | LFHSPSFYENL | 1355.5 | − | (SEQ ID NO: 328) |
| 410 | LFHSPSFWENL | 1378.6 | − | (SEQ ID NO: 329) |
| 412 | LFHSPSYPENL | 1305.5 | − | (SEQ ID NO: 330) |
| 413 | LFHSPSYFENL | 1355.5 | − | (SEQ ID NO: 331) |
| 414 | LFHSPSYYENL | 1371.5 | − | (SEQ ID NO: 332) |
| 415 | LFHSPSYWENL | 1394.6 | − | (SEQ ID NO: 333) |
| 417 | LFHSPSDPENL | 1257.4 | − | (SEQ ID NO: 334) |
| 418 | LFHSPSDFENL | 1307.4 | − | (SEQ ID NO: 335) |
| 419 | LFHSPSDYENL | 1323.4 | − | (SEQ ID NO: 336) |
| 420 | LFHSPSDWENL | 1346.5 | − | (SEQ ID NO: 337) |
| 422 | LFHSPSEPENL | 1271.4 | − | (SEQ ID NO: 338) |
| 423 | LFHSPSEFENL | 1321.4 | − | (SEQ ID NO: 339) |
| 424 | LFHSPSEYENL | 1337.4 | − | (SEQ ID NO: 340) |
| 425 | LFHSPSEWENL | 1360.5 | − | (SEQ ID NO: 341) |
| 427 | LFHSPSNPENL | 1256.5 | − | (SEQ ID NO: 342) |
| 428 | LFHSPSNFENL | 1306.5 | − | (SEQ ID NO: 343) |
| 429 | LFHSPSNYENL | 1322.5 | − | (SEQ ID NO: 344) |
| 430 | LFHSPSNWENL | 1345.6 | − | (SEQ ID NO: 345) |
| 432 | LFHSPSQPENL | 1270.5 | − | (SEQ ID NO: 346) |
| 433 | LFHSPSQFENL | 1320.5 | − | (SEQ ID NO: 347) |
| 434 | LFHSPSQYENL | 1336.5 | − | (SEQ ID NO: 348) |
| 435 | LFHSPSQWENL | 1359.6 | − | (SEQ ID NO: 349) |
| 437 | LFHSPSHPENL | 1279.5 | − | (SEQ ID NO: 350) |
| 438 | LFHSPSHFENL | 1329.5 | − | (SEQ ID NO: 351) |
| 439 | LFHSPSHYENL | 1345.5 | − | (SEQ ID NO: 352) |
| 440 | LFHSPSHWENL | 1368.6 | − | (SEQ ID NO: 353) |
| 442 | LFNSPSMPENL | 1250.6 | − | (SEQ ID NO: 354) |
| 443 | LFNSPSMFENL | 1300.6 | − | (SEQ ID NO: 355) |
| 444 | LFNSPSMYENL | 1316.6 | − | (SEQ ID NO: 356) |
| 445 | LFNSPSMWENL | 1339.7 | − | (SEQ ID NO: 357) |
| 447 | LFNSPSFPENL | 1266.5 | − | (SEQ ID NO: 358) |
| 448 | LFNSPSFFENL | 1316.5 | − | (SEQ ID NO: 359) |
| 449 | LFNSPSFYENL | 1332.5 | − | (SEQ ID NO: 360) |
| 450 | LFNSPSFWENL | 1355.6 | − | (SEQ ID NO: 361) |
| 452 | LFNSPSYPENL | 1282.5 | − | (SEQ ID NO: 362) |
| 453 | LFNSPSYFENL | 1332.5 | − | (SEQ ID NO: 363) |
| 454 | LFNSPSYYENL | 1348.5 | − | (SEQ ID NO: 364) |
| 455 | LFNSPSYWENL | 1371.6 | − | (SEQ ID NO: 365) |
| 457 | LFNSPSDPENL | 1234.4 | − | (SEQ ID NO: 366) |
| 458 | LFNSPSDFENL | 1284.4 | − | (SEQ ID NO: 367) |
| 459 | LFNSPSDYENL | 1300.4 | − | (SEQ ID NO: 368) |
| 460 | LFNSPSDWENL | 1323.5 | − | (SEQ ID NO: 369) |
| 462 | LFNSPSEPENL | 1248.4 | − | (SEQ ID NO: 370) |
| 463 | LFNSPSEFENL | 1298.4 | − | (SEQ ID NO: 371) |
| 464 | LFNSPSEYENL | 1314.4 | − | (SEQ ID NO: 372) |
| 465 | LFNSPSEWENL | 1337.5 | − | (SEQ ID NO: 373) |
| 467 | LFNSPSNPENL | 1233.5 | − | (SEQ ID NO: 374) |
| 468 | LFNSPSNFENL | 1283.5 | − | (SEQ ID NO: 375) |
| 469 | LFNSPSNYENL | 1299.5 | − | (SEQ ID NO: 376) |
| 470 | LFNSPSNWENL | 1322.6 | − | (SEQ ID NO: 377) |
| 472 | LFNSPSQPENL | 1247.5 | − | (SEQ ID NO: 378) |
| 473 | LFNSPSQFENL | 1297.5 | − | (SEQ ID NO: 379) |
| 474 | LFNSPSQYENL | 1313.5 | − | (SEQ ID NO: 380) |
| 475 | LFNSPSQWENL | 1336.6 | − | (SEQ ID NO: 381) |
| 477 | LFNSPSHPENL | 1256.5 | − | (SEQ ID NO: 382) |
| 478 | LFNSPSHFENL | 1306.5 | − | (SEQ ID NO: 383) |
| 479 | LFNSPSHYENL | 1322.5 | − | (SEQ ID NO: 384) |
| 480 | LFNSPSHWENL | 1345.6 | − | (SEQ ID NO: 385) |
| 482 | LFGSPSMPENL | 1193.5 | − | (SEQ ID NO: 386) |
| 483 | LFGSPSMFENL | 1243.5 | − | (SEQ ID NO: 387) |
| 484 | LFGSPSMYENL | 1259.5 | − | (SEQ ID NO: 388) |
| 485 | LFGSPSMWENL | 1282.6 | − | (SEQ ID NO: 389) |
| 487 | LFGSPSFPENL | 1209.4 | − | (SEQ ID NO: 390) |
| 488 | LFGSPSFFENL | 1259.4 | − | (SEQ ID NO: 391) |
| 489 | LFGSPSFYENL | 1275.4 | − | (SEQ ID NO: 392) |
| 490 | LFGSPSFWENL | 1298.5 | − | (SEQ ID NO: 393) |
| 492 | LFGSPSYPENL | 1225.4 | − | (SEQ ID NO: 394) |
| 493 | LFGSPSYFENL | 1275.4 | − | (SEQ ID NO: 395) |
| 494 | LFGSPSYYENL | 1291.4 | − | (SEQ ID NO: 396) |
| 495 | LFGSPSYWENL | 1314.5 | − | (SEQ ID NO: 397) |
| 497 | LFGSPSDPENL | 1177.3 | − | (SEQ ID NO: 398) |
| 498 | LFGSPSDFENL | 1227.3 | − | (SEQ ID NO: 399) |
| 499 | LFGSPSDYENL | 1243.3 | − | (SEQ ID NO: 400) |
| 500 | LFGSPSDWENL | 1266.4 | − | (SEQ ID NO: 401) |
| 502 | LFGSPSEPENL | 1191.3 | − | (SEQ ID NO: 402) |
| 503 | LFGSPSEFENL | 1241.3 | − | (SEQ ID NO: 403) |
| 504 | LFGSPSEYENL | 1257.3 | − | (SEQ ID NO: 404) |
| 505 | LFGSPSEWENL | 1280.4 | − | (SEQ ID NO: 405) |
| 507 | LFGSPSNPENL | 1176.4 | − | (SEQ ID NO: 406) |
| 508 | LFGSPSNFENL | 1226.4 | − | (SEQ ID NO: 407) |
| 509 | LFGSPSNYENL | 1242.4 | − | (SEQ ID NO: 408) |

TABLE 1-continued

| | | | | |
|---|---|---|---|---|
| 510 | LFGSPSNWENL | 1265.5 | − | (SEQ ID NO: 409) |
| 512 | LFGSPSQPENL | 1190.4 | − | (SEQ ID NO: 410) |
| 513 | LFGSPSQFENL | 1240.4 | − | (SEQ ID NO: 411) |
| 514 | LFGSPSQYENL | 1256.4 | − | (SEQ ID NO: 412) |
| 515 | LFGSPSQWENL | 1279.5 | − | (SEQ ID NO: 413) |
| 517 | LFGSPSHPENL | 1199.4 | − | (SEQ ID NO: 414) |
| 518 | LFGSPSHFENL | 1249.4 | − | (SEQ ID NO: 415) |
| 519 | LFGSPSHYENL | 1265.4 | − | (SEQ ID NO: 416) |
| 520 | LFGSPSHWENL | 1288.5 | − | (SEQ ID NO: 417) |
| 522 | LFASPSMPENL | 1207.5 | − | (SEQ ID NO: 418) |
| 523 | LFASPSMFENL | 1257.5 | − | (SEQ ID NO: 419) |
| 524 | LFASPSMYENL | 1273.5 | − | (SEQ ID NO: 420) |
| 525 | LFASPSMWENL | 1296.6 | − | (SEQ ID NO: 421) |
| 527 | LFASPSFPENL | 1223.4 | − | (SEQ ID NO: 422) |
| 528 | LFASPSFFENL | 1273.4 | − | (SEQ ID NO: 423) |
| 529 | LFASPSFYENL | 1289.4 | − | (SEQ ID NO: 424) |
| 530 | LFASPSFWENL | 1312.5 | − | (SEQ ID NO: 425) |
| 532 | LFASPSYPENL | 1239.4 | − | (SEQ ID NO: 426) |
| 533 | LFASPSYFENL | 1289.4 | − | (SEQ ID NO: 427) |
| 534 | LFASPSYYENL | 1305.4 | − | (SEQ ID NO: 428) |
| 535 | LFASPSYWENL | 1328.5 | − | (SEQ ID NO: 429) |
| 537 | LFASPSDPENL | 1191.3 | − | (SEQ ID NO: 430) |
| 538 | LFASPSDFENL | 1241.3 | − | (SEQ ID NO: 431) |
| 539 | LFASPSDYENL | 1257.3 | − | (SEQ ID NO: 432) |
| 540 | LFASPSDWENL | 1280.4 | − | (SEQ ID NO: 433) |
| 542 | LFASPSEPENL | 1205.3 | − | (SEQ ID NO: 434) |
| 543 | LFASPSEFENL | 1255.3 | − | (SEQ ID NO: 435) |
| 544 | LFASPSEYENL | 1271.3 | − | (SEQ ID NO: 436) |
| 545 | LFASPSEWENL | 1294.4 | − | (SEQ ID NO: 437) |
| 547 | LFASPSNPENL | 1190.4 | − | (SEQ ID NO: 438) |
| 548 | LFASPSNFENL | 1240.4 | − | (SEQ ID NO: 439) |
| 549 | LFASPSNYENL | 1256.4 | − | (SEQ ID NO: 440) |
| 550 | LFASPSNWENL | 1279.5 | − | (SEQ ID NO: 441) |
| 552 | LFASPSQPENL | 1204.4 | − | (SEQ ID NO: 442) |
| 553 | LFASPSQFENL | 1254.4 | − | (SEQ ID NO: 443) |
| 554 | LFASPSQYENL | 1270.4 | − | (SEQ ID NO: 444) |
| 555 | LFASPSQWENL | 1293.5 | − | (SEQ ID NO: 445) |
| 557 | LFASPSHPENL | 1213.4 | − | (SEQ ID NO: 446) |
| 558 | LFASPSHFENL | 1263.4 | − | (SEQ ID NO: 447) |
| 559 | LFASPSHYENL | 1279.4 | − | (SEQ ID NO: 448) |
| 560 | LFASPSHWENL | 1302.5 | − | (SEQ ID NO: 449) |
| 562 | FYRSPSMPENL | 1342.6 | − | (SEQ ID NO: 450) |
| 563 | FYRSPSMFENL | 1392.6 | − | (SEQ ID NO: 451) |
| 564 | FYRSPSMYENL | 1408.6 | − | (SEQ ID NO: 452) |
| 565 | FYRSPSMWENL | 1431.7 | − | (SEQ ID NO: 453) |
| 567 | FYRSPSFPENL | 1358.5 | − | (SEQ ID NO: 454) |
| 568 | FYRSPSFFENL | 1408.5 | − | (SEQ ID NO: 455) |
| 569 | FYRSPSFYENL | 1424.5 | − | (SEQ ID NO: 456) |
| 570 | FYRSPSFWENL | 1447.6 | − | (SEQ ID NO: 457) |
| 572 | FYRSPSYPENL | 1374.5 | − | (SEQ ID NO: 458) |
| 573 | FYRSPSYFENL | 1424.5 | − | (SEQ ID NO: 459) |
| 574 | FYRSPSYYENL | 1440.5 | − | (SEQ ID NO: 460) |
| 575 | FYRSPSYWENL | 1463.6 | − | (SEQ ID NO: 461) |
| 577 | FYRSPSDPENL | 1326.4 | − | (SEQ ID NO: 462) |
| 578 | FYRSPSDFENL | 1376.4 | − | (SEQ ID NO: 463) |
| 579 | FYRSPSDYENL | 1392.4 | − | (SEQ ID NO: 464) |
| 580 | FYRSPSDWENL | 1415.5 | − | (SEQ ID NO: 465) |
| 582 | FYRSPSEPENL | 1340.4 | − | (SEQ ID NO: 466) |
| 583 | FYRSPSEFENL | 1390.4 | − | (SEQ ID NO: 467) |
| 584 | FYRSPSEYENL | 1406.4 | − | (SEQ ID NO: 468) |
| 585 | FYRSPSEWENL | 1429.5 | − | (SEQ ID NO: 469) |
| 587 | FYRSPSNPENL | 1325.5 | − | (SEQ ID NO: 470) |
| 588 | FYRSPSNFENL | 1375.5 | − | (SEQ ID NO: 471) |
| 589 | FYRSPSNYENL | 1391.5 | − | (SEQ ID NO: 472) |
| 590 | FYRSPSNWENL | 1414.6 | − | (SEQ ID NO: 473) |
| 592 | FYRSPSQPENL | 1339.5 | − | (SEQ ID NO: 474) |
| 593 | FYRSPSQFENL | 1389.5 | − | (SEQ ID NO: 475) |
| 594 | FYRSPSQYENL | 1405.5 | − | (SEQ ID NO: 476) |
| 595 | FYRSPSQWENL | 1428.6 | − | (SEQ ID NO: 477) |
| 597 | FYRSPSHPENL | 1348.5 | − | (SEQ ID NO: 478) |
| 598 | FYRSPSHFENL | 1398.5 | − | (SEQ ID NO: 479) |
| 599 | FYRSPSHYENL | 1414.5 | − | (SEQ ID NO: 480) |
| 600 | FYRSPSHWENL | 1437.6 | − | (SEQ ID NO: 481) |
| 602 | FYSSPSMPENL | 1274.3 | − | (SEQ ID NO: 482) |
| 603 | FYSSPSMFENL | 1324.3 | − | (SEQ ID NO: 483) |
| 604 | FYSSPSMYENL | 1340.3 | − | (SEQ ID NO: 484) |
| 605 | FYSSPSMWENL | 1363.4 | − | (SEQ ID NO: 485) |
| 607 | FYSSPSFPENL | 1290.2 | − | (SEQ ID NO: 486) |
| 608 | FYSSPSFFENL | 1340.2 | − | (SEQ ID NO: 487) |
| 609 | FYSSPSFYENL | 1356.2 | − | (SEQ ID NO: 488) |
| 610 | FYSSPSFWENL | 1379.3 | − | (SEQ ID NO: 489) |
| 612 | FYSSPSYPENL | 1306.2 | − | (SEQ ID NO: 490) |
| 613 | FYSSPSYFENL | 1356.2 | − | (SEQ ID NO: 491) |
| 614 | FYSSPSYYENL | 1372.2 | − | (SEQ ID NO: 492) |
| 615 | FYSSPSYWENL | 1395.3 | − | (SEQ ID NO: 493) |
| 617 | FYSSPSDPENL | 1258.1 | − | (SEQ ID NO: 494) |
| 618 | FYSSPSDFENL | 1308.1 | − | (SEQ ID NO: 495) |
| 619 | FYSSPSDYENL | 1324.1 | − | (SEQ ID NO: 496) |
| 620 | FYSSPSDWENL | 1347.2 | − | (SEQ ID NO: 497) |
| 622 | FYSSPSEPENL | 1272.1 | − | (SEQ ID NO: 498) |
| 623 | FYSSPSEFENL | 1322.1 | − | (SEQ ID NO: 499) |
| 624 | FYSSPSEYENL | 1338.1 | − | (SEQ ID NO: 500) |
| 625 | FYSSPSEWENL | 1361.2 | − | (SEQ ID NO: 501) |
| 627 | FYSSPSNPENL | 1257.2 | − | (SEQ ID NO: 502) |
| 628 | FYSSPSNFENL | 1307.2 | − | (SEQ ID NO: 503) |
| 629 | FYSSPSNYENL | 1323.2 | − | (SEQ ID NO: 504) |
| 630 | FYSSPSNWENL | 1346.3 | − | (SEQ ID NO: 505) |
| 632 | FYSSPSQPENL | 1271.2 | − | (SEQ ID NO: 506) |
| 633 | FYSSPSQFENL | 1321.2 | − | (SEQ ID NO: 507) |
| 634 | FYSSPSQYENL | 1337.2 | − | (SEQ ID NO: 508) |
| 635 | FYSSPSQWENL | 1360.3 | − | (SEQ ID NO: 509) |
| 637 | FYSSPSHPENL | 1280.2 | + | (SEQ ID NO: 510) |
| 638 | FYSSPSHFENL | 1330.2 | + | (SEQ ID NO: 511) |
| 639 | FYSSPSHYENL | 1346.2 | + | (SEQ ID NO: 512) |
| 640 | FYSSPSHWENL | 1369.3 | + | (SEQ ID NO: 513) |
| 642 | FYTSPSMPENL | 1287.5 | + | (SEQ ID NO: 514) |
| 643 | FYTSPSMFENL | 1337.5 | + | (SEQ ID NO: 515) |
| 644 | FYTSPSMYENL | 1353.5 | + | (SEQ ID NO: 516) |
| 645 | FYTSPSMWENL | 1376.6 | + | (SEQ ID NO: 517) |
| 647 | FYTSPSFPENL | 1303.4 | + | (SEQ ID No: 518) |
| 648 | FYTSPSFFENL | 1353.4 | + | (SEQ ID NO: 519) |
| 649 | FYTSPSFYENL | 1369.4 | + | (SEQ ID NO: 520) |
| 650 | FYTSPSFWENL | 1392.5 | + | (SEQ ID NO: 521) |
| 652 | FYTSPSYPENL | 1319.4 | + | (SEQ ID NO: 522) |
| 653 | FYTSPSYFENL | 1369.4 | + | (SEQ ID NO: 523) |
| 654 | FYTSPSYYENL | 1385.4 | + | (SEQ ID NO: 524) |
| 655 | FYTSPSYWENL | 1408.5 | + | (SEQ ID NO: 525) |
| 657 | FYTSPSDPENL | 1271.3 | − | (SEQ ID NO: 526) |
| 658 | FYTSPSDFENL | 1321.3 | − | (SEQ ID NO: 527) |
| 659 | FYTSPSDYENL | 1337.3 | − | (SEQ ID NO: 528) |
| 660 | FYTSPSDWENL | 1360.4 | − | (SEQ ID NO: 529) |
| 662 | FYTSPSEPENL | 1285.3 | − | (SEQ ID NO: 530) |
| 663 | FYTSPSEFENL | 1335.3 | − | (SEQ ID NO: 531) |
| 664 | FYTSPSEYENL | 1351.3 | − | (SEQ ID NO: 532) |
| 665 | FYTSPSEWENL | 1374.4 | − | (SEQ ID NO: 533) |
| 667 | FYTSPSNPENL | 1270.4 | − | (SEQ ID NO: 534) |
| 668 | FYTSPSNFENL | 1320.4 | − | (SEQ ID NO: 535) |
| 669 | FYTSPSNYENL | 1336.4 | − | (SEQ ID NO: 536) |
| 670 | FYTSPSNWENL | 1359.5 | − | (SEQ ID NO: 537) |
| 672 | FYTSPSQPENL | 1284.4 | − | (SEQ ID NO: 538) |
| 673 | FYTSPSQFENL | 1334.4 | − | (SEQ ID NO: 539) |
| 674 | FYTSPSQYENL | 1350.4 | − | (SEQ ID NO: 540) |
| 675 | FYTSPSQWENL | 1373.5 | − | (SEQ ID NO: 541) |
| 677 | FYTSPSHPENL | 1293.4 | − | (SEQ ID NO: 542) |
| 678 | FYTSPSHFENL | 1343.4 | − | (SEQ ID NO: 543) |
| 679 | FYTSPSHYENL | 1359.4 | − | (SEQ ID NO: 544) |
| 680 | FYTSPSHWENL | 1382.5 | − | (SEQ ID NO: 545) |
| 682 | FYHSPSMPENL | 1323.6 | − | (SEQ ID NO: 546) |
| 683 | FYHSPSMFENL | 1373.6 | − | (SEQ ID NO: 547) |
| 684 | FYHSPSMYENL | 1389.6 | − | (SEQ ID NO: 548) |
| 685 | FYHSPSMWENL | 1412.7 | − | (SEQ ID NO: 549) |
| 687 | FYHSPSFPENL | 1339.5 | − | (SEQ ID NO: 550) |
| 688 | FYHSPSFFENL | 1389.5 | − | (SEQ ID NO: 551) |
| 689 | FYHSPSFYENL | 1405.5 | − | (SEQ ID NO: 552) |
| 690 | FYHSPSFWENL | 1428.6 | − | (SEQ ID NO: 553) |
| 692 | FYHSPSYPENL | 1355.5 | − | (SEQ ID NO: 554) |
| 693 | FYHSPSYFENL | 1405.5 | − | (SEQ ID NO: 555) |
| 694 | FYHSPSYYENL | 1421.5 | − | (SEQ ID NO: 556) |
| 695 | FYHSPSYWENL | 1444.6 | − | (SEQ ID NO: 557) |
| 697 | FYHSPSDPENL | 1307.4 | − | (SEQ ID NO: 558) |
| 698 | FYHSPSDFENL | 1357.4 | − | (SEQ ID NO: 559) |
| 699 | FYHSPSDYENL | 1373.4 | − | (SEQ ID NO: 560) |
| 700 | FYHSPSDWENL | 1396.5 | − | (SEQ ID NO: 561) |
| 702 | FYHSPSEPENL | 1321.4 | − | (SEQ ID NO: 562) |
| 703 | FYHSPSEFENL | 1371.4 | − | (SEQ ID NO: 563) |
| 704 | FYHSPSEYENL | 1387.4 | − | (SEQ ID NO: 564) |
| 705 | FYHSPSEWENL | 1410.5 | − | (SEQ ID NO: 565) |
| 707 | FYHSPSNPENL | 1306.5 | − | (SEQ ID NO: 566) |

TABLE 1-continued

| | | | | |
|---|---|---|---|---|
| 708 | FYHSPSNFENL | 1356.5 | - | (SEQ ID NO: 567) |
| 709 | FYHSPSNYENL | 1372.5 | - | (SEQ ID NO: 568) |
| 710 | FYHSPSNWENL | 1395.6 | - | (SEQ ID NO: 569) |
| 712 | FYHSPSQPENL | 1320.5 | - | (SEQ ID NO: 570) |
| 713 | FYHSPSQFENL | 1370.5 | - | (SEQ ID NO: 571) |
| 714 | FYHSPSQYENL | 1386.5 | - | (SEQ ID NO: 572) |
| 715 | FYHSPSQWENL | 1409.6 | - | (SEQ ID NO: 573) |
| 717 | FYHSPSHPENL | 1329.5 | - | (SEQ ID NO: 574) |
| 718 | FYHSPSHFENL | 1379.5 | - | (SEQ ID NO: 575) |
| 719 | FYHSPSHYENL | 1395.5 | - | (SEQ ID NO: 576) |
| 720 | FYHSPSHWENL | 1418.6 | - | (SEQ ID NO: 577) |
| 722 | FYNSPSMPENL | 1300.6 | - | (SEQ ID NO: 578) |
| 723 | FYNSPSMFENL | 1350.6 | - | (SEQ ID NO: 579) |
| 724 | FYNSPSMYENL | 1366.6 | - | (SEQ ID NO: 580) |
| 725 | FYNSPSMWENL | 1389.7 | - | (SEQ ID NO: 581) |
| 727 | FYNSPSFPENL | 1316.5 | - | (SEQ ID NO: 582) |
| 728 | FYNSPSFFENL | 1366.5 | - | (SEQ ID NO: 583) |
| 729 | FYNSPSFYENL | 1382.5 | - | (SEQ ID NO: 584) |
| 730 | FYNSPSFWENL | 1405.6 | - | (SEQ ID NO: 585) |
| 732 | FYNSPSYPENL | 1332.5 | - | (SEQ ID NO: 586) |
| 733 | FYNSPSYFENL | 1382.5 | - | (SEQ ID NO: 587) |
| 734 | FYNSPSYYENL | 1398.5 | - | (SEQ ID NO: 588) |
| 735 | FYNSPSYWENL | 1421.6 | - | (SEQ ID NO: 589) |
| 737 | FYNSPSDPENL | 1284.4 | - | (SEQ ID NO: 590) |
| 738 | FYNSPSDFENL | 1334.4 | - | (SEQ ID NO: 591) |
| 739 | FYNSPSDYENL | 1350.4 | - | (SEQ ID NO: 592) |
| 740 | FYNSPSDWENL | 1373.5 | - | (SEQ ID NO: 593) |
| 742 | FYNSPSEPENL | 1298.4 | - | (SEQ ID NO: 594) |
| 743 | FYNSPSEFENL | 1348.4 | - | (SEQ ID NO: 595) |
| 744 | FYNSPSEYENL | 1364.4 | - | (SEQ ID NO: 596) |
| 745 | FYNSPSEWENL | 1387.5 | - | (SEQ ID NO: 597) |
| 747 | FYNSPSNPENL | 1283.5 | - | (SEQ ID NO: 598) |
| 748 | FYNSPSNFENL | 1333.5 | - | (SEQ ID NO: 599) |
| 749 | FYNSPSNYENL | 1349.5 | - | (SEQ ID NO: 600) |
| 750 | FYNSPSNWENL | 1372.6 | - | (SEQ ID NO: 601) |
| 752 | FYNSPSQPENL | 1297.5 | - | (SEQ ID NO: 602) |
| 753 | FYNSPSQFENL | 1347.5 | - | (SEQ ID NO: 603) |
| 754 | FYNSPSQYENL | 1363.5 | - | (SEQ ID NO: 604) |
| 755 | FYNSPSQWENL | 1386.6 | - | (SEQ ID NO: 605) |
| 757 | FYNSPSHPENL | 1306.5 | - | (SEQ ID NO: 606) |
| 758 | FYNSPSHFENL | 1356.5 | - | (SEQ ID NO: 607) |
| 759 | FYNSPSHYENL | 1372.5 | - | (SEQ ID NO: 608) |
| 760 | FYNSPSHWENL | 1395.6 | - | (SEQ ID NO: 609) |
| 762 | FYGSPSMPENL | 1243.5 | - | (SEQ ID NO: 610) |
| 763 | FYGSPSMFENL | 1293.5 | - | (SEQ ID NO: 611) |
| 764 | FYGSPSMYENL | 1309.5 | - | (SEQ ID NO: 612) |
| 765 | FYGSPSMWENL | 1332.6 | - | (SEQ ID NO: 613) |
| 767 | FYGSPSFPENL | 1259.4 | - | (SEQ ID NO: 614) |
| 768 | FYGSPSFFENL | 1309.4 | - | (SEQ ID NO: 615) |
| 769 | FYGSPSFYENL | 1325.4 | - | (SEQ ID NO: 616) |
| 770 | FYGSPSFWENL | 1348.5 | - | (SEQ ID NO: 617) |
| 772 | FYGSPSYPENL | 1275.4 | - | (SEQ ID NO: 618) |
| 773 | FYGSPSYFENL | 1325.4 | - | (SEQ ID NO: 619) |
| 774 | FYGSPSYYENL | 1341.4 | - | (SEQ ID NO: 620) |
| 775 | FYGSPSYWENL | 1364.5 | - | (SEQ ID NO: 621) |
| 777 | FYGSPSDPENL | 1227.3 | - | (SEQ ID NO: 622) |
| 778 | FYGSPSDFENL | 1277.3 | - | (SEQ ID NO: 623) |
| 779 | FYGSPSDYENL | 1293.3 | - | (SEQ ID NO: 624) |
| 780 | FYGSPSDWENL | 1316.4 | - | (SEQ ID NO: 625) |
| 782 | FYGSPSEPENL | 1241.3 | - | (SEQ ID NO: 626) |
| 783 | FYGSPSEFENL | 1291.3 | - | (SEQ ID NO: 627) |
| 784 | FYGSPSEYENL | 1307.3 | - | (SEQ ID NO: 628) |
| 785 | FYGSPSEWENL | 1330.4 | - | (SEQ ID NO: 629) |
| 787 | FYGSPSNPENL | 1226.4 | - | (SEQ ID NO: 630) |
| 788 | FYGSPSNFENL | 1276.4 | - | (SEQ ID NO: 631) |
| 789 | FYGSPSNYENL | 1292.4 | - | (SEQ ID NO: 632) |
| 790 | FYGSPSNWENL | 1315.5 | - | (SEQ ID NO: 633) |
| 792 | FYGSPSQPENL | 1240.4 | - | (SEQ ID NO: 634) |
| 793 | FYGSPSQFENL | 1290.4 | - | (SEQ ID NO: 635) |
| 794 | FYGSPSQYENL | 1306.4 | - | (SEQ ID NO: 636) |
| 795 | FYGSPSQWENL | 1329.5 | - | (SEQ ID NO: 637) |
| 797 | FYGSPSHPENL | 1249.4 | - | (SEQ ID NO: 638) |
| 798 | FYGSPSHFENL | 1299.4 | - | (SEQ ID NO: 639) |
| 799 | FYGSPSHYENL | 1315.4 | - | (SEQ ID NO: 640) |
| 800 | FYGSPSHWENL | 1338.5 | - | (SEQ ID NO: 641) |
| 802 | FYASPSMPENL | 1257.5 | - | (SEQ ID NO: 642) |
| 803 | FYASPSMFENL | 1307.5 | - | (SEQ ID NO: 643) |
| 804 | FYASPSMYENL | 1323.5 | - | (SEQ ID NO: 644) |
| 805 | FYASPSMWENL | 1346.6 | - | (SEQ ID NO: 645) |
| 807 | FYASPSFPENL | 1273.4 | - | (SEQ ID NO: 646) |
| 808 | FYASPSFFENL | 1323.4 | - | (SEQ ID NO: 647) |
| 809 | FYASPSFYENL | 1339.4 | - | (SEQ ID NO: 648) |
| 810 | FYASPSFWENL | 1362.5 | - | (SEQ ID NO: 649) |
| 812 | FYASPSYPENL | 1289.4 | - | (SEQ ID NO: 650) |
| 813 | FYASPSYFENL | 1339.4 | - | (SEQ ID NO: 651) |
| 814 | FYASPSYYENL | 1355.4 | - | (SEQ ID NO: 652) |
| 815 | FYASPSYWENL | 1378.5 | - | (SEQ ID NO: 653) |
| 817 | FYASPSDPENL | 1241.3 | - | (SEQ ID NO: 654) |
| 818 | FYASPSDFENL | 1291.3 | - | (SEQ ID NO: 655) |
| 819 | FYASPSDYENL | 1307.3 | - | (SEQ ID NO: 656) |
| 820 | FYASPSDWENL | 1330.4 | - | (SEQ ID NO: 657) |
| 822 | FYASPSEPENL | 1255.3 | - | (SEQ ID NO: 658) |
| 823 | FYASPSEFENL | 1305.3 | - | (SEQ ID NO: 659) |
| 824 | FYASPSEYENL | 1321.3 | - | (SEQ ID NO: 660) |
| 825 | FYASPSEWENL | 1344.4 | - | (SEQ ID NO: 661) |
| 827 | FYASPSNPENL | 1240.4 | - | (SEQ ID NO: 662) |
| 828 | FYASPSNFENL | 1290.4 | - | (SEQ ID NO: 663) |
| 829 | FYASPSNYENL | 1306.4 | - | (SEQ ID NO: 664) |
| 830 | FYASPSNWENL | 1329.5 | - | (SEQ ID NO: 665) |
| 832 | FYASPSQPENL | 1254.4 | - | (SEQ ID NO: 666) |
| 833 | FYASPSQFENL | 1304.4 | - | (SEQ ID NO: 667) |
| 834 | FYASPSQYENL | 1320.4 | - | (SEQ ID NO: 668) |
| 835 | FYASPSQWENL | 1343.5 | - | (SEQ ID NO: 669) |
| 837 | FYASPSHPENL | 1263.4 | - | (SEQ ID NO: 670) |
| 838 | FYASPSHFENL | 1313.4 | - | (SEQ ID NO: 671) |
| 839 | FYASPSHYENL | 1329.4 | - | (SEQ ID NO: 672) |
| 840 | FYASFSHWENL | 1352.5 | - | (SEQ ID NO: 673) |
| 842 | FFRSPSMPENL | 1326.6 | - | (SEQ ID NO: 674) |
| 843 | FFRSPSMFENL | 1376.6 | - | (SEQ ID NO: 675) |
| 844 | FFRSPSMYENL | 1392.6 | - | (SEQ ID NO: 676) |
| 845 | FFRSPSMWENL | 1415.7 | - | (SEQ ID NO: 677) |
| 847 | FFRSPSFPENL | 1342.5 | - | (SEQ ID NO: 678) |
| 848 | FFRSPSFFENL | 1392.5 | - | (SEQ ID NO: 679) |
| 849 | FFRSPSFYENL | 1408.5 | - | (SEQ ID NO: 680) |
| 850 | FFRSPSFWENL | 1431.6 | - | (SEQ ID NO: 681) |
| 852 | FFRSPSYPENL | 1358.5 | - | (SEQ ID NO: 682) |
| 853 | FFRSPSYFENL | 1408.5 | - | (SEQ ID NO: 683) |
| 854 | FFRSPSYYENL | 1424.5 | - | (SEQ ID NO: 684) |
| 855 | FFRSPSYWENL | 1447.6 | - | (SEQ ID NO: 685) |
| 857 | FFRSPSDPENL | 1310.4 | - | (SEQ ID NO: 686) |
| 858 | FFRSPSDFENL | 1360.4 | - | (SEQ ID NO: 687) |
| 859 | FFRSPSDYENL | 1376.4 | - | (SEQ ID NO: 688) |
| 860 | FFRSPSDWENL | 1399.5 | - | (SEQ ID NO: 689) |
| 862 | FFRSPSEPENL | 1324.4 | - | (SEQ ID NO: 690) |
| 863 | FFRSPSEFENL | 1374.4 | - | (SEQ ID NO: 691) |
| 864 | FFRSPSEYENL | 1390.4 | - | (SEQ ID NO: 692) |
| 865 | FFRSPSEWENL | 1413.5 | - | (SEQ ID NO: 693) |
| 867 | FFRSPSNPENL | 1309.5 | - | (SEQ ID NO: 694) |
| 868 | FFRSPSNFENL | 1359.5 | - | (SEQ ID NO: 695) |
| 869 | FFRSPSNYENL | 1375.5 | - | (SEQ ID NO: 696) |
| 870 | FFRSPSNWENL | 1398.6 | - | (SEQ ID NO: 697) |
| 872 | FFRSPSQPENL | 1323.5 | - | (SEQ ID NO: 698) |
| 873 | FFRSPSQFENL | 1373.5 | - | (SEQ ID NO: 699) |
| 874 | FFRSPSQYENL | 1389.5 | - | (SEQ ID NO: 700) |
| 875 | FFRSPSQWENL | 1412.6 | - | (SEQ ID NO: 701) |
| 877 | FFRSPSHPENL | 1332.5 | - | (SEQ ID NO: 702) |
| 878 | FFRSPSHFENL | 1382.5 | - | (SEQ ID NO: 703) |
| 879 | FFRSPSHYENL | 1398.5 | - | (SEQ ID NO: 704) |
| 880 | FFRSPSHWENL | 1421.6 | - | (SEQ ID NO: 705) |
| 882 | FFSSPSMPENL | 1258.3 | - | (SEQ ID NO: 706) |
| 883 | FFSSPSMFENL | 1308.3 | - | (SEQ ID NO: 707) |
| 884 | FFSSPSMYENL | 1324.3 | - | (SEQ ID NO: 708) |
| 885 | FFSSPSMWENL | 1347.4 | - | (SEQ ID NO: 709) |
| 887 | FFSSPSFPENL | 1274.2 | - | (SEQ ID NO: 710) |
| 888 | FFSSPSFFENL | 1324.2 | - | (SEQ ID NO: 711) |
| 889 | FFSSPSFYENL | 1340.2 | - | (SEQ ID NO: 712) |
| 890 | FFSSPSFWENL | 1363.3 | - | (SEQ ID NO: 713) |
| 892 | FFSSPSYPENL | 1290.2 | - | (SEQ ID NO: 714) |
| 893 | FFSSPSYFENL | 1340.2 | - | (SEQ ID NO: 715) |
| 894 | FFSSPSYYENL | 1356.2 | - | (SEQ ID NO: 316) |
| 895 | FFSSPSYWENL | 1379.3 | - | (SEQ ID NO: 717) |
| 897 | FFSSPSDPENL | 1242.1 | - | (SEQ ID NO: 718) |
| 898 | FFSSPSDFENL | 1292.1 | - | (SEQ ID NO: 719) |
| 899 | FFSSPSDYENL | 1308.1 | - | (SEQ ID NO: 720) |
| 900 | FFSSPSDWENL | 1331.2 | - | (SEQ ID NO: 721) |
| 902 | FFSSPSEPENL | 1256.1 | - | (SEQ ID NO: 722) |
| 903 | FFSSPSEFENL | 1306.1 | - | (SEQ ID NO: 723) |
| 904 | FFSSPSEYENL | 1322.1 | - | (SEQ ID NO: 724) |

TABLE 1-continued

| | | | | |
|---|---|---|---|---|
| 905 | FFSSPSEWENL | 1345.2 | - | (SEQ ID NO: 725) |
| 907 | FFSSPSNPENL | 1241.2 | - | (SEQ ID NO: 726) |
| 908 | FFSSPSNFENL | 1291.2 | - | (SEQ ID NO: 727) |
| 909 | FFSSPSNYENL | 1307.2 | - | (SEQ ID NO: 728) |
| 910 | FFSSPSNWENL | 1330.3 | - | (SEQ ID NO: 729) |
| 912 | FFSSPSQPENL | 1255.2 | - | (SEQ ID NO: 730) |
| 913 | FFSSPSQFENL | 1305.2 | - | (SEQ ID NO: 731) |
| 914 | FFSSPSQYENL | 1321.2 | - | (SEQ ID NO: 732) |
| 915 | FFSSPSQWENL | 1344.3 | - | (SEQ ID NO: 733) |
| 917 | FFSSPSHPENL | 1264.2 | - | (SEQ ID NO: 734) |
| 918 | FFSSPSHFENL | 1314.2 | - | (SEQ ID NO: 735) |
| 919 | FFSSPSHYENL | 1330.2 | - | (SEQ ID NO: 736) |
| 920 | FFSSPSHWENL | 1353.3 | - | (SEQ ID NO: 737) |
| 922 | FFTSPSMPENL | 1271.5 | - | (SEQ ID NO: 738) |
| 923 | FFTSPSMFENL | 1321.5 | - | (SEQ ID NO: 739) |
| 924 | FFTSPSMYENL | 1337.5 | - | (SEQ ID NO: 740) |
| 925 | FFTSPSMWENL | 1360.6 | - | (SEQ ID NO: 741) |
| 927 | FFTSPSFPENL | 1287.4 | - | (SEQ ID NO: 742) |
| 928 | FFTSPSFFENL | 1337.4 | - | (SEQ ID NO: 743) |
| 929 | FFTSPSFYENL | 1353.4 | - | (SEQ ID NO: 744) |
| 930 | FFTSPSFWENL | 1376.5 | - | (SEQ ID NO: 745) |
| 932 | FFTSPSYPENL | 1303.4 | - | (SEQ ID NO: 746) |
| 933 | FFTSPSYFENL | 1353.4 | - | (SEQ ID NO: 747) |
| 934 | FFTSPSYYENL | 1369.4 | - | (SEQ ID NO: 748) |
| 935 | FFTSPSYWENL | 1392.5 | - | (SEQ ID NO: 749) |
| 937 | FFTSPSDPENL | 1255.3 | - | (SEQ ID NO: 750) |
| 938 | FFTSPSDFENL | 1305.3 | - | (SEQ ID NO: 751) |
| 939 | FFTSPSDYENL | 1321.3 | - | (SEQ ID NO: 752) |
| 940 | FFTSPSDWENL | 1344.4 | - | (SEQ ID NO: 753) |
| 942 | FFTSPSEPENL | 1269.3 | - | (SEQ ID NO: 754) |
| 943 | FFTSPSEFENL | 1319.3 | - | (SEQ ID NO: 755) |
| 944 | FFTSPSEYENL | 1335.3 | - | (SEQ ID NO: 756) |
| 945 | FFTSPSEWENL | 1358.4 | - | (SEQ ID NO: 757) |
| 947 | FFTSPSNPENL | 1254.4 | - | (SEQ ID NO: 758) |
| 948 | FFTSPSNFENL | 1304.4 | - | (SEQ ID NO: 759) |
| 949 | FFTSPSNYENL | 1320.4 | - | (SEQ ID NO: 760) |
| 950 | FFTSPSNWENL | 1343.5 | - | (SEQ ID NO: 761) |
| 952 | FFTSPSQPENL | 1268.4 | - | (SEQ ID NO: 762) |
| 953 | FFTSPSQFENL | 1318.4 | - | (SEQ ID NO: 763) |
| 954 | FFTSPSQYENL | 1334.4 | - | (SEQ ID NO: 764) |
| 955 | FFTSPSQWENL | 1357.5 | - | (SEQ ID NO: 765) |
| 957 | FFTSPSHPENL | 1277.4 | - | (SEQ ID NO: 766) |
| 958 | FFTSPSHFENL | 1327.4 | - | (SEQ ID NO: 767) |
| 959 | FFTSPSHYENL | 1343.4 | - | (SEQ ID NO: 768) |
| 960 | FFTSPSHWENL | 1366.5 | - | (SEQ ID NO: 769) |
| 962 | FFHSPSMPENL | 1307.6 | - | (SEQ ID NO: 770) |
| 963 | FFHSPSMFENL | 1357.6 | - | (SEQ ID NO: 771) |
| 964 | FFHSPSMYENL | 1373.6 | - | (SEQ ID NO: 772) |
| 965 | FFHSPSMWENL | 1396.7 | - | (SEQ ID NO: 773) |
| 967 | FFHSPSFPENL | 1323.5 | - | (SEQ ID NO: 774) |
| 968 | FFHSPSFFENL | 1373.5 | - | (SEQ ID NO: 775) |
| 969 | FFHSPSFYENL | 1389.5 | - | (SEQ ID NO: 776) |
| 970 | FFHSPSFWENL | 1412.6 | - | (SEQ ID NO: 777) |
| 972 | FFHSPSYPENL | 1339.5 | - | (SEQ ID NO: 778) |
| 973 | FFHSPSYFENL | 1389.5 | - | (SEQ ID NO: 779) |
| 974 | FFHSPSYYENL | 1405.5 | - | (SEQ ID NO: 780) |
| 975 | FFHSPSYWENL | 1428.6 | - | (SEQ ID NO: 781) |
| 977 | FFHSPSDPENL | 1291.4 | - | (SEQ ID NO: 782) |
| 978 | FFHSPSDFENL | 1341.4 | - | (SEQ ID NO: 783) |
| 979 | FFHSPSDYENL | 1357.4 | - | (SEQ ID NO: 784) |
| 980 | FFHSPSDWENL | 1380.5 | - | (SEQ ID NO: 785) |
| 982 | FFHSPSEPENL | 1305.4 | - | (SEQ ID NO: 786) |
| 983 | FFHSPSEFENL | 1355.4 | - | (SEQ ID NO: 787) |
| 984 | FFHSPSEYENL | 1371.4 | - | (SEQ ID NO: 788) |
| 985 | FFHSPSEWENL | 1394.5 | - | (SEQ ID NO: 789) |
| 987 | FFHSPSNPENL | 1290.5 | - | (SEQ ID NO: 790) |
| 988 | FFHSPSNFENL | 1340.5 | - | (SEQ ID NO: 791) |
| 989 | FFHSPSNYENL | 1356.5 | - | (SEQ ID NO: 792) |
| 990 | FFHSPSNWENL | 1379.6 | - | (SEQ ID NO: 793) |
| 992 | FFHSPSQPENL | 1304.5 | - | (SEQ ID NO: 794) |
| 993 | FFHSPSQFENL | 1354.5 | - | (SEQ ID NO: 795) |
| 994 | FFHSPSQYENL | 1370.5 | - | (SEQ ID NO: 796) |
| 995 | FFHSPSQWENL | 1393.6 | - | (SEQ ID NO: 797) |
| 997 | FFHSPSHPENL | 1313.5 | - | (SEQ ID NO: 798) |
| 998 | FFHSPSHFENL | 1363.5 | - | (SEQ ID NO: 799) |
| 999 | FFHSPSHYENL | 1379.5 | - | (SEQ ID NO: 800) |
| 1000 | FFHSPSHWENL | 1402.6 | - | (SEQ ID NO: 801) |
| 1002 | FFNSPSMPENL | 1284.6 | - | (SEQ ID NO: 802) |
| 1003 | FFNSPSMFENL | 1334.6 | - | (SEQ ID NO: 803) |
| 1004 | FFNSPSMYENL | 1350.6 | - | (SEQ ID NO: 804) |
| 1005 | FFNSPSMWENL | 1373.7 | - | (SEQ ID NO: 805) |
| 1007 | FFNSPSFPENL | 1300.5 | - | (SEQ ID NO: 806) |
| 1008 | FFNSPSFFENL | 1350.5 | - | (SEQ ID NO: 807) |
| 1009 | FFNSPSFYENL | 1366.5 | - | (SEQ ID NO: 808) |
| 1010 | FFNSPSFWENL | 1389.6 | - | (SEQ ID NO: 809) |
| 1012 | FFNSPSYPENL | 1316.5 | - | (SEQ ID NO: 810) |
| 1013 | FFNSPSYFENL | 1366.5 | - | (SEQ ID NO: 811) |
| 1014 | FFNSPSYYENL | 1382.5 | - | (SEQ ID NO: 812) |
| 1015 | FFNSPSYWENL | 1405.6 | - | (SEQ ID NO: 813) |
| 1017 | FFNSPSDPENL | 1268.4 | - | (SEQ ID NO: 814) |
| 1018 | FFNSPSDFENL | 1318.4 | - | (SEQ ID NO: 815) |
| 1019 | FFNSPSDYENL | 1334.4 | - | (SEQ ID NO: 816) |
| 1020 | FFNSPSDWENL | 1357.5 | - | (SEQ ID NO: 817) |
| 1022 | FFNSPSEPENL | 1282.4 | - | (SEQ ID NO: 818) |
| 1023 | FFNSPSEFENL | 1332.4 | - | (SEQ ID NO: 819) |
| 1024 | FFNSPSEYENL | 1348.4 | - | (SEQ ID NO: 820) |
| 1025 | FFNSPSEWENL | 1371.5 | - | (SEQ ID NO: 821) |
| 1027 | FFNSPSNPENL | 1267.5 | - | (SEQ ID NO: 822) |
| 1028 | FFNSPSNFENL | 1317.5 | - | (SEQ ID NO: 823) |
| 1029 | FFNSPSNYENL | 1333.5 | - | (SEQ ID NO: 824) |
| 1030 | FFNSPSNWENL | 1356.6 | - | (SEQ ID NO: 825) |
| 1032 | FFNSPSQPENL | 1281.5 | - | (SEQ ID NO: 826) |
| 1033 | FFNSPSQFENL | 1331.5 | - | (SEQ ID NO: 827) |
| 1034 | FFNSPSQYENL | 1347.5 | - | (SEQ ID NO: 828) |
| 1035 | FFNSPSQWENL | 1370.6 | - | (SEQ ID NO: 829) |
| 1037 | FFNSPSHPENL | 1290.5 | - | (SEQ ID NO: 830) |
| 1038 | FFNSPSHFENL | 1340.5 | - | (SEQ ID NO: 831) |
| 1039 | FFNSPSHYENL | 1356.5 | - | (SEQ ID NO: 832) |
| 1040 | FFNSPSHWENL | 1379.6 | - | (SEQ ID NO: 833) |
| 1042 | FFGSPSMPENL | 1227.5 | - | (SEQ ID NO: 834) |
| 1043 | FFGSPSMFENL | 1277.5 | - | (SEQ ID NO: 835) |
| 1044 | FFGSPSMNENL | 1293.5 | - | (SEQ ID NO: 836) |
| 1045 | FFGSPSMWENL | 1316.6 | - | (SEQ ID NO: 837) |
| 1047 | FFGSPSFPENL | 1243.4 | - | (SEQ ID NO: 838) |
| 1048 | FFGSPSFFENL | 1293.4 | - | (SEQ ID NO: 839) |
| 1049 | FFGSPSFYENL | 1309.4 | - | (SEQ ID NO: 840) |
| 1050 | FFGSPSFWENL | 1332.5 | - | (SEQ ID NO: 841) |
| 1052 | FFGSPSYPENL | 1259.4 | - | (SEQ ID NO: 842) |
| 1053 | FFGSPSYFENL | 1309.4 | - | (SEQ ID NO: 843) |
| 1054 | FFGSPSYYENL | 1325.4 | - | (SEQ ID NO: 844) |
| 1055 | FFGSPSYWENL | 1348.5 | - | (SEQ ID NO: 845) |
| 1057 | FFGSPSDPENL | 1211.3 | - | (SEQ ID NO: 846) |
| 1058 | FFGSPSDFENL | 1261.3 | - | (SEQ ID NO: 847) |
| 1059 | FFGSPSDYENL | 1277.3 | - | (SEQ ID NO: 848) |
| 1060 | FFGSPSDWENL | 1300.4 | - | (SEQ ID NO: 849) |
| 1062 | FFGSPSEPENL | 1225.3 | - | (SEQ ID NO: 850) |
| 1063 | FFGSPSEFENL | 1275.3 | - | (SEQ ID NO: 851) |
| 1064 | FFGSPSEYENL | 1291.3 | - | (SEQ ID NO: 852) |
| 1065 | FFGSPSEWENL | 1314.4 | - | (SEQ ID NO: 853) |
| 1067 | FFGSPSNPENL | 1210.4 | - | (SEQ ID NO: 854) |
| 1068 | FFGSPSNFENL | 1260.4 | - | (SEQ ID NO: 855) |
| 1069 | FFGSPSNYENL | 1276.4 | - | (SEQ ID NO: 856) |
| 1070 | FFGSPSNWENL | 1299.5 | - | (SEQ ID NO: 857) |
| 1072 | FFGSPSQPENL | 1224.4 | - | (SEQ ID NO: 858) |
| 1073 | FFGSPSQFENL | 1274.4 | - | (SEQ ID NO: 859) |
| 1074 | FFGSPSQYENL | 1290.4 | - | (SEQ ID NO: 860) |
| 1075 | FFGSPSQWENL | 1313.5 | - | (SEQ ID NO: 861) |
| 1077 | FFGSPSHPENL | 1233.4 | - | (SEQ ID NO: 862) |
| 1078 | FFGSPSHFENL | 1283.4 | - | (SEQ ID NO: 863) |
| 1079 | FFGSPSHYENL | 1299.4 | - | (SEQ ID NO: 864) |
| 1080 | FFGSPSHWENL | 1322.5 | - | (SEQ ID NO: 865) |
| 1082 | FFASPSMPENL | 1241.5 | - | (SEQ ID NO: 866) |
| 1083 | FFASPSMFENL | 1291.5 | - | (SEQ ID NO: 867) |
| 1084 | FFASPSMYENL | 1307.5 | - | (SEQ ID NO: 868) |
| 1085 | FFASPSMWENL | 1330.6 | - | (SEQ ID NO: 869) |
| 1087 | FFASPSFPENL | 1257.4 | - | (SEQ ID NO: 870) |
| 1088 | FFASPSFFENL | 1307.4 | - | (SEQ ID NO: 871) |
| 1089 | FFASPSFYENL | 1323.4 | - | (SEQ ID NO: 872) |
| 1090 | FFASPSFWENL | 1346.5 | - | (SEQ ID NO: 873) |
| 1092 | FFASPSYPENL | 1273.4 | - | (SEQ ID NO: 874) |
| 1093 | FFASPSYFENL | 1323.4 | - | (SEQ ID NO: 875) |
| 1094 | FFASPSYYENL | 1339.4 | - | (SEQ ID NO: 876) |
| 1095 | FFASPSYWENL | 1362.5 | - | (SEQ ID NO: 877) |
| 1097 | FFASPSDPENL | 1225.3 | - | (SEQ ID NO: 878) |
| 1098 | FFASPSDFENL | 1275.3 | - | (SEQ ID NO: 879) |
| 1099 | FFASPSDYENL | 1291.3 | - | (SEQ ID NO: 880) |
| 1100 | FFASPSDWENL | 1314.4 | - | (SEQ ID NO: 881) |
| 1102 | FFASPSEPENL | 1239.3 | - | (SEQ ID NO: 882) |

TABLE 1-continued

| | | | | | |
|---|---|---|---|---|---|
| 1103 | FFASPSEFENL | 1289.3 | − | (SEQ ID NO: 883) |
| 1104 | FFASPSEYENL | 1305.3 | − | (SEQ ID NO: 884) |
| 1105 | FFASPSEWENL | 1328.4 | − | (SEQ ID NO: 885) |
| 1107 | FFASPSNPENL | 1224.4 | − | (SEQ ID NO: 886) |
| 1108 | FFASPSNFENL | 1274.4 | − | (SEQ ID NO: 887) |
| 1109 | FFASPSNYENL | 1290.4 | − | (SEQ ID NO: 888) |
| 1110 | FFASPSNWENL | 1313.5 | − | (SEQ ID NO: 889) |
| 1112 | FFASPSQPENL | 1238.4 | − | (SEQ ID NO: 890) |
| 1113 | FFASPSQFENL | 1288.4 | − | (SEQ ID NO: 891) |
| 1114 | FFASPSQYENL | 1304.4 | − | (SEQ ID NO: 892) |
| 1115 | FFASPSQWENL | 1327.5 | − | (SEQ ID NO: 893) |
| 1117 | FFASPSHPENL | 1247.4 | − | (SEQ ID NO: 894) |
| 1118 | FFASPSHFENL | 1297.4 | − | (SEQ ID NO: 895) |
| 1119 | FFASPSHYENL | 1313.4 | − | (SEQ ID NO: 896) |
| 1120 | FFASPSHWENL | 1336.5 | − | (SEQ ID NO: 897) |
| 1122 | WYRSPSMPENL | 1381.7 | + | (SEQ ID NO: 898) |
| 1123 | WYRSPSMFENL | 1431.7 | + | (SEQ ID NO: 899) |
| 1124 | WYRSPSMYENL | 1447.7 | ++ | (SEQ ID NO: 900) |
| 1125 | WYRSPSMWENL | 1470.8 | ++ | (SEQ ID NO: 901) |
| 1127 | WYRSPSFPENL | 1397.6 | ++ | (SEQ ID NO: 902) |
| 1128 | WYRSPSFFENL | 1447.6 | ++ | (SEQ ID NO: 903) |
| 1129 | WYRSPSFYENL | 1463.6 | +++ | (SEQ ID NO: 904) |
| 1130 | WYRSPSFWENL | 1486.7 | ++ | (SEQ ID NO: 905) |
| 1132 | WYRSPSYPENL | 1413.6 | ++ | (SEQ ID NO: 906) |
| 1133 | WYRSPSYFENL | 1463.6 | + | (SEQ ID NO: 907) |
| 1134 | WYRSPSYYENL | 1479.6 | ++ | (SEQ ID NO: 908) |
| 1135 | WYRSPSYWENL | 1502.7 | + | (SEQ ID NO: 909) |
| 1137 | WYRSPSDPENL | 1365.5 | − | (SEQ ID NO: 910) |
| 1138 | WYRSPSDFENL | 1415.5 | − | (SEQ ID NO: 911) |
| 1139 | WYRSPSDYENL | 1431.5 | − | (SEQ ID NO: 912) |
| 1140 | WYRSPSDWENL | 1454.6 | − | (SEQ ID NO: 913) |
| 1142 | WYRSPSEPENL | 1379.5 | − | (SEQ ID NO: 914) |
| 1143 | WYRSPSEFENL | 1429.5 | − | (SEQ ID NO: 915) |
| 1144 | WYRSPSEYENL | 1445.5 | − | (SEQ ID NO: 916) |
| 1145 | WYRSPSEWENL | 1468.6 | − | (SEQ ID NO: 917) |
| 1147 | WYRSPSNPENL | 1364.6 | − | (SEQ ID NO: 918) |
| 1148 | WYRSPSNFENL | 1414.6 | − | (SEQ ID NO: 919) |
| 1149 | WYRSPSNYENL | 1430.6 | − | (SEQ ID NO: 920) |
| 1150 | WYRSPSNWENL | 1453.7 | − | (SEQ ID NO: 921) |
| 1152 | WYRSPSQPENL | 1378.6 | − | (SEQ ID NO: 922) |
| 1153 | WYRSPSQFENL | 1428.6 | − | (SEQ ID NO: 923) |
| 1154 | WYRSPSQYENL | 1444.6 | − | (SEQ ID NO: 924) |
| 1155 | WYRSPSQWENL | 1467.7 | − | (SEQ ID NO: 925) |
| 1157 | WYRSPSHPENL | 1387.6 | − | (SEQ ID NO: 926) |
| 1158 | WYRSPSHFENL | 1437.6 | − | (SEQ ID NO: 927) |
| 1159 | WYRSPSHYENL | 1453.6 | − | (SEQ ID NO: 928) |
| 1160 | WYRSPSHWENL | 1476.7 | − | (SEQ ID NO: 929) |
| 1162 | WYSSPSMPENL | 1313.4 | − | (SEQ ID NO: 930) |
| 1163 | WYSSPSMFENL | 1363.4 | − | (SEQ ID NO: 931) |
| 1164 | WYSSPSMYENL | 1379.4 | − | (SEQ ID NO: 932) |
| 1165 | WYSSPSMWENL | 1402.5 | − | (SEQ ID NO: 933) |
| 1167 | WYSSPSFPENL | 1329.3 | − | (SEQ ID NO: 934) |
| 1168 | WYSSPSFFENL | 1379.3 | − | (SEQ ID NO: 935) |
| 1169 | WYSSPSFYENL | 1395.3 | − | (SEQ ID NO: 936) |
| 1170 | WYSSPSFWENL | 1418.4 | − | (SEQ ID NO: 937) |
| 1172 | WYSSPSYPENL | 1345.3 | − | (SEQ ID NO: 938) |
| 1173 | WYSSPSYFENL | 1395.3 | − | (SEQ ID NO: 939) |
| 1174 | WYSSPSYYENL | 1411.3 | − | (SEQ ID NO: 940) |
| 1175 | WYSSPSYWENL | 1434.4 | − | (SEQ ID NO: 941) |
| 1177 | WYSSPSDPENL | 1297.2 | − | (SEQ ID NO: 942) |
| 1178 | WYSSPSDFENL | 1347.2 | − | (SEQ ID NO: 943) |
| 1179 | WYSSPSDYENL | 1363.2 | − | (SEQ ID NO: 944) |
| 1180 | WYSSPSDWENL | 1386.3 | − | (SEQ ID NO: 945) |
| 1182 | WYSSPSEPENL | 1311.2 | − | (SEQ ID NO: 946) |
| 1183 | WYSSPSEFENL | 1361.2 | − | (SEQ ID NO: 947) |
| 1184 | WYSSPSEYENL | 1377.2 | − | (SEQ ID NO: 948) |
| 1185 | WYSSPSEWENL | 1400.3 | − | (SEQ ID NO: 949) |
| 1187 | WYSSPSNPENL | 1296.3 | − | (SEQ ID NO: 950) |
| 1188 | WYSSPSNFENL | 1346.3 | − | (SEQ ID NO: 951) |
| 1189 | WYSSPSNYENL | 1362.3 | − | (SEQ ID NO: 952) |
| 1190 | WYSSPSNWENL | 1385.4 | − | (SEQ ID NO: 953) |
| 1192 | WYSSPSQPENL | 1310.3 | − | (SEQ ID NO: 954) |
| 1193 | WYSSPSQFENL | 1360.3 | − | (SEQ ID NO: 955) |
| 1194 | WYSSPSQYENL | 1376.3 | − | (SEQ ID NO: 956) |
| 1195 | WYSSPSQWENL | 1399.4 | − | (SEQ ID NO: 957) |
| 1197 | WYSSPSHPENL | 1319.3 | − | (SEQ ID NO: 958) |
| 1198 | WYSSPSHFENL | 1369.3 | − | (SEQ ID NO: 959) |
| 1199 | WYSSPSHYENL | 1385.3 | − | (SEQ ID NO: 960) |
| 1200 | WYSSPSHWENL | 1408.4 | − | (SEQ ID NO: 961) |
| 1202 | WYTSPSMPENL | 1326.6 | + | (SEQ ID NO: 962) |
| 1203 | WYTSPSMFENL | 1376.6 | + | (SEQ ID NO: 963) |
| 1204 | WYTSPSMYENL | 1392.6 | + | (SEQ ID NO: 964) |
| 1205 | WYTSPSMWENL | 1415.7 | + | (SEQ ID NO: 965) |
| 1207 | WYTSPSFPENL | 1342.5 | + | (SEQ ID NO: 966) |
| 1208 | WYTSPSFFENL | 1392.5 | + | (SEQ ID NO: 967) |
| 1209 | WYTSPSFYENL | 1408.5 | + | (SEQ ID NO: 968) |
| 1210 | WYTSPSFWENL | 1431.6 | + | (SEQ ID NO: 969) |
| 1212 | WYTSPSYPENL | 1358.5 | ++ | (SEQ ID NO: 970) |
| 1213 | WYTSPSYFENL | 1408.5 | + | (SEQ ID NO: 971) |
| 1214 | WYTSPSYYENL | 1424.5 | + | (SEQ ID NO: 972) |
| 1215 | WYTSPSYWENL | 1447.6 | + | (SEQ ID NO: 973) |
| 1217 | WYTSPSDPENL | 1310.4 | − | (SEQ ID NO: 974) |
| 1218 | WYTSPSDFENL | 1360.4 | − | (SEQ ID NO: 975) |
| 1219 | WYTSPSDYENL | 1376.4 | − | (SEQ ID NO: 976) |
| 1220 | WYTSPSDWENL | 1399.5 | − | (SEQ ID NO: 977) |
| 1222 | WYTSPSEPENL | 1324.4 | − | (SEQ ID NO: 978) |
| 1223 | WYTSPSEFENL | 1374.4 | − | (SEQ ID NO: 979) |
| 1224 | WYTSPSEYENL | 1390.4 | − | (SEQ ID NO: 980) |
| 1225 | WYTSPSEWENL | 1413.5 | − | (SEQ ID NO: 981) |
| 1227 | WYTSPSNPENL | 1309.5 | − | (SEQ ID NO: 982) |
| 1228 | WYTSPSNFENL | 1359.5 | − | (SEQ ID NO: 983) |
| 1229 | WYTSPSNYENL | 1375.5 | − | (SEQ ID NO: 984) |
| 1230 | WYTSPSNWENL | 1398.6 | − | (SEQ ID NO: 985) |
| 1232 | WYTSPSQPENL | 1323.5 | − | (SEQ ID NO: 986) |
| 1233 | WYTSPSQFENL | 1373.5 | − | (SEQ ID NO: 987) |
| 1234 | WYTSPSQYENL | 1389.5 | − | (SEQ ID NO: 988) |
| 1235 | WYTSPSQWENL | 1412.6 | − | (SEQ ID NO: 989) |
| 1237 | WYTSPSHPENL | 1332.5 | + | (SEQ ID NO: 990) |
| 1238 | WYTSPSHFENL | 1382.5 | + | (SEQ ID NO: 991) |
| 1239 | WYTSPSHYENL | 1398.5 | + | (SEQ ID NO: 992) |
| 1240 | WYTSPSHWENL | 1421.6 | + | (SEQ ID NO: 993) |
| 1242 | WYHSPSMPENL | 1362.7 | − | (SEQ ID NO: 994) |
| 1243 | WYHSPSMFENL | 1412.7 | − | (SEQ ID NO: 995) |
| 1244 | WYHSPSMYENL | 1428.7 | − | (SEQ ID NO: 996) |
| 1245 | WYHSPSMWENL | 1451.8 | − | (SEQ ID NO: 997) |
| 1247 | WYHSPSFPENL | 1378.6 | − | (SEQ ID NO: 998) |
| 1248 | WYHSPSFFENL | 1428.6 | − | (SEQ ID NO: 999) |
| 1249 | WYHSPSFYENL | 1444.6 | − | (SEQ ID NO: 1000) |
| 1250 | WYHSPSFWENL | 1467.7 | − | (SEQ ID NO: 1001) |
| 1252 | WYHSPSYPENL | 1394.6 | − | (SEQ ID NO: 1002) |
| 1253 | WYHSPSYFENL | 1444.6 | − | (SEQ ID NO: 1003) |
| 1254 | WYHSPSYYENL | 1460.6 | − | (SEQ ID NO: 1004) |
| 1255 | WYHSPSYWENL | 1483.7 | − | (SEQ ID NO: 1005) |
| 1257 | WYHSPSDPENL | 1346.5 | − | (SEQ ID NO: 1006) |
| 1258 | WYHSPSDFENL | 1396.5 | − | (SEQ ID NO: 1007) |
| 1259 | WYHSPSDYENL | 1412.5 | − | (SEQ ID NO: 1008) |
| 1260 | WYHSPSDWENL | 1435.6 | − | (SEQ ID NO: 1009) |
| 1262 | WYHSPSEPENL | 1360.5 | − | (SEQ ID NO: 1010) |
| 1263 | WYHSPSEFENL | 1410.5 | − | (SEQ ID NO: 1011) |
| 1264 | WYHSPSEYENL | 1426.5 | − | (SEQ ID NO: 1012) |
| 1265 | WYHSPSEWENL | 1449.6 | − | (SEQ ID NO: 1013) |
| 1267 | WYHSPSNPENL | 1345.6 | − | (SEQ ID NO: 1014) |
| 1268 | WYHSPSNFENL | 1395.6 | − | (SEQ ID NO: 1015) |
| 1269 | WYHSPSNYENL | 1411.6 | − | (SEQ ID NO: 1016) |
| 1270 | WYHSPSNWENL | 1434.7 | − | (SEQ ID NO: 1017) |
| 1272 | WYHSPSQPENL | 1359.6 | − | (SEQ ID NO: 1018) |
| 1273 | WYHSPSQFENL | 1409.6 | − | (SEQ ID NO: 1019) |
| 1274 | WYHSPSQYENL | 1425.6 | − | (SEQ ID NO: 1020) |
| 1275 | WYHSPSQWENL | 1448.7 | − | (SEQ ID NO: 1021) |
| 1277 | WYHSPSHPENL | 1368.6 | − | (SEQ ID NO: 1022) |
| 1278 | WYHSPSHFENL | 1418.6 | − | (SEQ ID NO: 1023) |
| 1279 | WYHSPSHYENL | 1434.6 | − | (SEQ ID NO: 1024) |
| 1280 | WYHSPSHWENL | 1457.7 | − | (SEQ ID NO: 1025) |
| 1282 | WYNSPSMPENL | 1339.7 | − | (SEQ ID NO: 1026) |
| 1283 | WYNSPSMEENL | 1389.7 | − | (SEQ ID NO: 1027) |
| 1284 | WYNSPSMYENL | 1405.7 | − | (SEQ ID NO: 1028) |
| 1285 | WYNSPSMWENL | 1428.8 | − | (SEQ ID NO: 1029) |
| 1287 | WYNSPSFPENL | 1355.6 | − | (SEQ ID NO: 1030) |
| 1288 | WYNSPSFFENL | 1405.6 | − | (SEQ ID NO: 1031) |
| 1289 | WYNSPSFYENL | 1421.6 | − | (SEQ ID NO: 1032) |
| 1290 | WYNSPSFWENL | 1444.7 | − | (SEQ ID NO: 1033) |
| 1292 | WYNSPSYPENL | 1371.6 | − | (SEQ ID NO: 1034) |
| 1293 | WYNSPSYFENL | 1421.6 | − | (SEQ ID NO: 1035) |
| 1294 | WYNSPSYYENL | 1437.6 | − | (SEQ ID NO: 1036) |
| 1295 | WYNSPSYWENL | 1460.7 | − | (SEQ ID NO: 1037) |
| 1297 | WYNSPSDPENL | 1323.5 | − | (SEQ ID NO: 1038) |
| 1298 | WYNSPSDFENL | 1373.5 | − | (SEQ ID NO: 1039) |
| 1299 | WYNSPSDYENL | 1389.5 | − | (SEQ ID NO: 1040) |

TABLE 1-continued

| | | | | |
|---|---|---|---|---|
| 1300 | WYNSPSDWENL | 1412.6 | - | (SEQ ID NO: 1041) |
| 1302 | WYNSPSEPENL | 1337.5 | - | (SEQ ID NO: 1042) |
| 1303 | WYNSPSEFENL | 1387.5 | - | (SEQ ID NO: 1043) |
| 1304 | WYNSPSEYENL | 1403.5 | - | (SEQ ID NO: 1044) |
| 1305 | WYNSPSEWENL | 1426.6 | - | (SEQ ID NO: 1045) |
| 1307 | WYNSPSNPENL | 1322.6 | - | (SEQ ID NO: 1046) |
| 1308 | WYNSPSNFENL | 1372.6 | - | (SEQ ID NO: 1047) |
| 1309 | WYNSPSNYENL | 1388.6 | - | (SEQ ID NO: 1048) |
| 1310 | WYNSPSNWENL | 1411.7 | - | (SEQ ID NO: 1049) |
| 1312 | WYNSPSQPENL | 1336.6 | - | (SEQ ID NO: 1050) |
| 1313 | WYNSPSQFENL | 1386.6 | - | (SEQ ID NO: 1051) |
| 1314 | WYNSPSQYENL | 1402.6 | - | (SEQ ID NO: 1052) |
| 1315 | WYNSPSQWENL | 1425.7 | - | (SEQ ID NO: 1053) |
| 1317 | WYNSPSHPENL | 1345.6 | - | (SEQ ID NO: 1054) |
| 1318 | WYNSPSHFENL | 1395.6 | - | (SEQ ID NO: 1055) |
| 1319 | WYNSPSHYENL | 1411.6 | - | (SEQ ID NO: 1056) |
| 1320 | WYNSPSHWENL | 1434.7 | - | (SEQ ID NO: 1057) |
| 1322 | WYGSPSMPENL | 1282.6 | - | (SEQ ID NO: 1058) |
| 1323 | WYGSPSMFENL | 1332.6 | - | (SEQ ID NO: 1059) |
| 1324 | WYGSPSMYENL | 1348.6 | - | (SEQ ID NO: 1060) |
| 1325 | WYGSPSMWENL | 1371.7 | - | (SEQ ID NO: 1061) |
| 1327 | WYGSPSFPENL | 1298.5 | - | (SEQ ID NO: 1062) |
| 1328 | WYGSPSFFENL | 1348.5 | - | (SEQ ID NO: 1063) |
| 1329 | WYGSPSFYENL | 1364.5 | - | (SEQ ID NO: 1064) |
| 1330 | WYGSPSFWENL | 1387.6 | - | (SEQ ID NO: 1065) |
| 1332 | WYGSPSYPENL | 1314.5 | - | (SEQ ID NO: 1066) |
| 1333 | WYGSPSYFENL | 1364.5 | - | (SEQ ID NO: 1067) |
| 1334 | WYGSPSYYENL | 1380.5 | - | (SEQ ID NO: 1068) |
| 1335 | WYGSPSYWENL | 1403.6 | - | (SEQ ID NO: 1069) |
| 1337 | WYGSPSDPENL | 1266.4 | - | (SEQ ID NO: 1070) |
| 1338 | WYGSPSDFENL | 1316.4 | - | (SEQ ID NO: 1071) |
| 1339 | WYGSPSDYENL | 1332.4 | - | (SEQ ID NO: 1072) |
| 1340 | WYGSPSDWENL | 1355.5 | - | (SEQ ID NO: 1073) |
| 1342 | WYGSPSEPENL | 1280.4 | - | (SEQ ID NO: 1074) |
| 1343 | WYGSPSEFENL | 1330.4 | - | (SEQ ID NO: 1075) |
| 1344 | WYGSPSEYENL | 1346.4 | - | (SEQ ID NO: 1076) |
| 1345 | WYGSPSEWENL | 1369.5 | - | (SEQ ID NO: 1077) |
| 1347 | WYGSPSNPENL | 1265.5 | - | (SEQ ID NO: 1078) |
| 1348 | WYGSPSNFENL | 1315.5 | - | (SEQ ID NO: 1079) |
| 1349 | WYGSPSNYENL | 1331.5 | - | (SEQ ID NO: 1080) |
| 1350 | WYGSPSNWENL | 1354.6 | - | (SEQ ID NO: 1081) |
| 1352 | WYGSPSQPENL | 1279.5 | - | (SEQ ID NO: 1082) |
| 1353 | WYGSPSQFENL | 1329.5 | - | (SEQ ID NO: 1083) |
| 1354 | WYGSPSQYENL | 1345.5 | - | (SEQ ID NO: 1084) |
| 1355 | WYGSPSQWENL | 1368.6 | - | (SEQ ID NO: 1085) |
| 1357 | WYGSPSHPENL | 1288.5 | - | (SEQ ID NO: 1086) |
| 1358 | WYGSPSHFENL | 1338.5 | - | (SEQ ID NO: 1087) |
| 1359 | WYGSPSHYENL | 1354.5 | - | (SEQ ID NO: 1088) |
| 1360 | WYGSPSHWENL | 1377.6 | - | (SEQ ID NO: 1089) |
| 1362 | WYASPSMPENL | 1296.6 | - | (SEQ ID NO: 1090) |
| 1363 | WYASPSMFENL | 1346.6 | - | (SEQ ID NO: 1091) |
| 1364 | WYASPSMYENL | 1362.6 | - | (SEQ ID NO: 1092) |
| 1365 | WYASPSMWENL | 1385.7 | - | (SEQ ID NO: 1093) |
| 1367 | WYASPSFPENL | 1312.5 | - | (SEQ ID NO: 1094) |
| 1368 | WYASPSFFENL | 1362.5 | - | (SEQ ID NO: 1095) |
| 1369 | WYASPSFYENL | 1378.5 | - | (SEQ ID NO: 1096) |
| 1370 | WYASPSFWENL | 1401.6 | - | (SEQ ID NO: 1097) |
| 1372 | WYASPSYPENL | 1328.5 | - | (SEQ ID NO: 1098) |
| 1373 | WYASPSYFENL | 1378.5 | - | (SEQ ID NO: 1099) |
| 1374 | WYASPSYYENL | 1394.5 | - | (SEQ ID NO: 1100) |
| 1375 | WYASPSYWENL | 1417.6 | - | (SEQ ID NO: 1101) |
| 1377 | WYASPSDPENL | 1280.4 | - | (SEQ ID NO: 1102) |
| 1378 | WYASPSDFENL | 1330.4 | - | (SEQ ID NO: 1103) |
| 1379 | WYASPSDYENL | 1346.4 | - | (SEQ ID NO: 1104) |
| 1380 | WYASPSDWENL | 1369.5 | - | (SEQ ID NO: 1105) |
| 1382 | WYASPSEPENL | 1294.4 | - | (SEQ ID NO: 1106) |
| 1383 | WYASPSEFENL | 1344.4 | - | (SEQ ID NO: 1107) |
| 1384 | WYASPSEYENL | 1360.4 | - | (SEQ ID NO: 1108) |
| 1385 | WYASPSEWENL | 1383.5 | - | (SEQ ID NO: 1109) |
| 1387 | WYASPSNPENL | 1279.5 | - | (SEQ ID NO: 1110) |
| 1388 | WYASPSNFENL | 1329.5 | - | (SEQ ID NO: 1111) |
| 1389 | WYASPSNYENL | 1345.5 | - | (SEQ ID NO: 1112) |
| 1390 | WYASPSNWENL | 1368.6 | - | (SEQ ID NO: 1113) |
| 1392 | WYASPSQPENL | 1293.5 | - | (SEQ ID NO: 1114) |
| 1393 | WYASPSQFENL | 1343.5 | - | (SEQ ID NO: 1115) |
| 1394 | WYASPSQYENL | 1359.5 | - | (SEQ ID NO: 1116) |
| 1395 | WYASPSQWENL | 1382.6 | - | (SEQ ID NO: 1117) |
| 1397 | WYASPSHPENL | 1302.5 | - | (SEQ ID NO: 1118) |
| 1398 | WYASPSHFENL | 1352.5 | - | (SEQ ID NO: 1119) |
| 1399 | WYASPSHYENL | 1368.5 | - | (SEQ ID NO: 1120) |
| 1400 | WYASPSHWENL | 1391.6 | - | (SEQ ID NO: 1121) |
| 1402 | WFRSPSMPENL | 1365.7 | - | (SEQ ID NO: 1122) |
| 1403 | WFRSPSMFENL | 1415.7 | - | (SEQ ID NO: 1123) |
| 1404 | WFRSPSMYENL | 1431.7 | - | (SEQ ID NO: 1124) |
| 1405 | WFRSPSMWENL | 1454.8 | - | (SEQ ID NO: 1125) |
| 1407 | WFRSPSFPENL | 1381.6 | - | (SEQ ID NO: 1126) |
| 1408 | WFRSPSFFENL | 1431.6 | - | (SEQ ID NO: 1127) |
| 1409 | WFRSPSFYENL | 1447.6 | - | (SEQ ID NO: 1128) |
| 1410 | WFRSPSFWENL | 1470.7 | - | (SEQ ID NO: 1129) |
| 1412 | WFRSPSYPENL | 1397.6 | - | (SEQ ID NO: 1130) |
| 1413 | WFRSPSYFENL | 1447.6 | - | (SEQ ID NO: 1131) |
| 1414 | WFRSPSYYENL | 1463.6 | - | (SEQ ID NO: 1132) |
| 1415 | WFRSPSYWENL | 1486.7 | - | (SEQ ID NO: 1133) |
| 1417 | WFRSPSDPENL | 1349.5 | - | (SEQ ID NO: 1134) |
| 1418 | WFRSPSDFENL | 1399.5 | - | (SEQ ID NO: 1135) |
| 1419 | WFRSPSDYENL | 1415.5 | - | (SEQ ID NO: 1136) |
| 1420 | WFRSPSDWENL | 1438.6 | - | (SEQ ID NO: 1137) |
| 1422 | WFRSPSEPENL | 1363.5 | - | (SEQ ID NO: 1138) |
| 1423 | WFRSPSEFENL | 1413.5 | - | (SEQ ID NO: 1139) |
| 1424 | WFRSPSEYENL | 1429.5 | - | (SEQ ID NO: 1140) |
| 1425 | WFRSPSEWENL | 1452.6 | - | (SEQ ID NO: 1141) |
| 1427 | WFRSPSNPENL | 1348.6 | - | (SEQ ID NO: 1142) |
| 1428 | WFRSPSNFENL | 1398.6 | - | (SEQ ID NO: 1143) |
| 1429 | WFRSPSNYENL | 1414.6 | - | (SEQ ID NO: 1144) |
| 1430 | WFRSPSNWENL | 1437.7 | - | (SEQ ID NO: 1145) |
| 1432 | WFRSPSQPENL | 1362.6 | - | (SEQ ID NO: 1146) |
| 1433 | WFRSPSQFENL | 1412.6 | - | (SEQ ID NO: 1147) |
| 1434 | WFRSPSQYENL | 1428.6 | - | (SEQ ID NO: 1148) |
| 1435 | WFRSPSQWENL | 1451.7 | - | (SEQ ID NO: 1149) |
| 1437 | WFRSPSHPENL | 1371.6 | - | (SEQ ID NO: 1150) |
| 1438 | WFRSPSHFENL | 1421.6 | - | (SEQ ID NO: 1151) |
| 1439 | WFRSPSHYENL | 1437.6 | - | (SEQ ID NO: 1152) |
| 1440 | WFRSPSHWENL | 1460.7 | - | (SEQ ID NO: 1153) |
| 1442 | WFSSPSMPENL | 1297.4 | - | (SEQ ID NO: 1154) |
| 1443 | WFSSPSMFENL | 1347.4 | - | (SEQ ID NO: 1155) |
| 1444 | WFSSPSMYENL | 1363.4 | - | (SEQ ID NO: 1156) |
| 1445 | WFSSPSMWENL | 1386.5 | - | (SEQ ip NO: 1157) |
| 1447 | WFSSPSFPENL | 1313.3 | - | (SEQ ID NO: 1158) |
| 1448 | WFSSPSFFENL | 1363.3 | - | (SEQ ID NO: 1159) |
| 1449 | WFSSPSFYENL | 1379.3 | - | (SEQ ID NO: 1160) |
| 1450 | WFSSPSFWENL | 1402.4 | - | (SEQ ID NO: 1161) |
| 1452 | WFSSPSYPENL | 1329.3 | - | (SEQ ID NO: 1162) |
| 1453 | WFSSPSYFENL | 1379.3 | - | (SEQ ID NO: 1163) |
| 1454 | WFSSPSYYENL | 1395.3 | - | (SEQ ID NO: 1164) |
| 1455 | WFSSPSYWENL | 1418.4 | - | (SEQ ID NO: 1165) |
| 1457 | WFSSPSDPENL | 1281.2 | - | (SEQ ID NO: 1166) |
| 1458 | WFSSPSDFENL | 1331.2 | - | (SEQ ID NO: 1167) |
| 1459 | WFSSPSDYENL | 1347.2 | - | (SEQ ID NO: 1168) |
| 1460 | WFSSPSDWENL | 1370.3 | - | (SEQ ID NO: 1169) |
| 1462 | WFSSPSEPENL | 1295.2 | - | (SEQ ID NO: 1170) |
| 1463 | WFSSPSEFENL | 1345.2 | - | (SEQ ID NO: 1171) |
| 1464 | WFSSPSEYENL | 1361.2 | - | (SEQ ID NO: 1172) |
| 1465 | WFSSPSEWENL | 1384.3 | - | (SEQ ID NO: 1173) |
| 1467 | WFSSPSNPENL | 1280.3 | - | (SEQ ID NO: 1174) |
| 1468 | WFSSPSNFENL | 1330.3 | - | (SEQ ID NO: 1175) |
| 1469 | WFSSPSNYENL | 1346.3 | - | (SEQ ID NO: 1176) |
| 1470 | WFSSPSNWENL | 1369.4 | - | (SEQ ID NO: 1177) |
| 1472 | WFSSPSQPENL | 1294.3 | - | (SEQ ID NO: 1178) |
| 1473 | WFSSPSQFENL | 1344.3 | - | (SEQ ID NO: 1179) |
| 1474 | WFSSPSQYENL | 1360.3 | - | (SEQ ID NO: 1180) |
| 1475 | WFSSPSQWENL | 1383.4 | - | (SEQ ID NO: 1181) |
| 1477 | WFSSPSHPENL | 1303.3 | - | (SEQ ID NO: 1182) |
| 1478 | WFSSPSHFENL | 1353.3 | - | (SEQ ID NO: 1183) |
| 1479 | WFSSPSHYENL | 1369.3 | - | (SEQ ID NO: 1184) |
| 1480 | WFSSPSHWENL | 1392.4 | - | (SEQ ID NO: 1185) |
| 1482 | WFTSPSMPENL | 1310.6 | - | (SEQ ID NO: 1186) |
| 1483 | WFTSPSMFENL | 1360.6 | - | (SEQ ID NO: 1187) |
| 1484 | WFTSPSMYENL | 1376.6 | - | (SEQ ID NO: 1188) |
| 1485 | WFTSPSMWENL | 1399.7 | - | (SEQ ID NO: 1189) |
| 1487 | WFTSPSFPENL | 1326.5 | - | (SEQ ID NO: 1190) |
| 1488 | WFTSPSFFENL | 1376.5 | - | (SEQ ID NO: 1191) |
| 1489 | WFTSPSFYENL | 1392.5 | - | (SEQ ID NO: 1192) |
| 1490 | WFTSPSFWENL | 1415.6 | - | (SEQ ID NO: 1193) |
| 1492 | WFTSPSYPENL | 1342.5 | - | (SEQ ID NO: 1194) |
| 1493 | WFTSPSYFENL | 1392.5 | - | (SEQ ID NO: 1195) |
| 1494 | WFTSPSYYENL | 1408.5 | - | (SEQ ID NO: 1196) |
| 1495 | WFTSPSYWENL | 1431.6 | - | (SEQ ID NO: 1197) |
| 1497 | WFTSPSDPENL | 1294.4 | - | (SEQ ID NO: 1198) |

TABLE 1-continued

| | | | | | |
|---|---|---|---|---|---|
| 1498 | WFTSPSDFENL | 1344.4 | – | (SEQ ID NO: | 1199) |
| 1499 | WFTSPSDYENL | 1360.4 | – | (SEQ ID NO: | 1200) |
| 1500 | WFTSPSDWENL | 1383.5 | – | (SEQ ID NO: | 1201) |
| 1502 | WFTSPSEPENL | 1308.4 | – | (SEQ ID NO: | 1202) |
| 1503 | WFTSPSEFENL | 1358.4 | – | (SEQ ID NO: | 1203) |
| 1504 | WFTSPSEYENL | 1374.4 | – | (SEQ ID NO: | 1204) |
| 1505 | WFTSPSEWENL | 1397.5 | – | (SEQ ID NO: | 1205) |
| 1507 | WFTSPSNPENL | 1293.5 | – | (SEQ ID NO: | 1206) |
| 1508 | WFTSPSNFENL | 1343.5 | – | (SEQ ID NO: | 1207) |
| 1509 | WFTSPSNYENL | 1359.5 | – | (SEQ ID NO: | 1208) |
| 1510 | WFTSPSNWENL | 1382.6 | – | (SEQ ID NO: | 1209) |
| 1512 | WFTSPSQPENL | 1307.5 | – | (SEQ ID NO: | 1210) |
| 1513 | WFTSPSQFENL | 1357.5 | – | (SEQ ID NO: | 1211) |
| 1514 | WFTSPSQYENL | 1373.5 | – | (SEQ ID NO: | 1212) |
| 1515 | WFTSPSQWENL | 1396.6 | – | (SEQ ID NO: | 1213) |
| 1517 | WFTSPSHPENL | 1316.5 | – | (SEQ ID NO: | 1214) |
| 1518 | WFTSPSHFENL | 1366.5 | – | (SEQ ID NO: | 1215) |
| 1519 | WFTSPSHYENL | 1382.5 | – | (SEQ ID NO: | 1216) |
| 1520 | WFTSPSHWENL | 1405.6 | – | (SEQ ID NO: | 1217) |
| 1522 | WFHSPSMPENL | 1346.7 | – | (SEQ ID NO: | 1218) |
| 1523 | WFHSPSMFENL | 1396.7 | – | (SEQ ID NO: | 1219) |
| 1524 | WFHSPSMYENL | 1412.7 | – | (SEQ ID NO: | 1220) |
| 1525 | WFHSPSMWENL | 1435.8 | – | (SEQ ID NO: | 1221) |
| 1527 | WFHSPSFPENL | 1362.6 | – | (SEQ ID NO: | 1222) |
| 1528 | WFHSPSFFENL | 1412.6 | – | (SEQ ID NO: | 1223) |
| 1529 | WFHSPSFYENL | 1428.6 | – | (SEQ ID NO: | 1224) |
| 1530 | WFHSPSFWENL | 1451.7 | – | (SEQ ID NO: | 1225) |
| 1532 | WFHSPSYPENL | 1378.6 | – | (SEQ ID NO: | 1226) |
| 1533 | WFHSPSYFENL | 1428.6 | – | (SEQ ID NO: | 1227) |
| 1534 | WFHSPSYYENL | 1444.6 | – | (SEQ ID NO: | 1228) |
| 1535 | WFHSPSYWENL | 1467.7 | – | (SEQ ID NO: | 1229) |
| 1537 | WFHSPSDPENL | 1330.5 | – | (SEQ ID NO: | 1230) |
| 1538 | WFHSPSDFENL | 1380.5 | – | (SEQ ID NO: | 1231) |
| 1539 | WFHSPSDYENL | 1396.5 | – | (SEQ ID NO: | 1232) |
| 1540 | WFHSPSDWENL | 1419.6 | – | (SEQ ID NO: | 1233) |
| 1542 | WFHSPSEPENL | 1344.5 | – | (SEQ ID NO: | 1234) |
| 1543 | WFHSPSEFENL | 1394.5 | – | (SEQ ID NO: | 1235) |
| 1544 | WFHSPSEYENL | 1410.5 | – | (SEQ ID NO: | 1236) |
| 1545 | WFHSPSEWENL | 1433.6 | – | (SEQ ID NO: | 1237) |
| 1547 | WFHSPSNPENL | 1329.6 | – | (SEQ ID NO: | 1238) |
| 1548 | WFHSPSNFENL | 1379.6 | – | (SEQ ID NO: | 1239) |
| 1549 | WFHSPSNYENL | 1395.6 | – | (SEQ ID NO: | 1240) |
| 1550 | WFHSPSNWENL | 1418.7 | – | (SEQ ID NO: | 1241) |
| 1552 | WFHSPSQPENL | 1343.6 | – | (SEQ ID NO: | 1242) |
| 1553 | WFHSPSQFENL | 1393.6 | – | (SEQ ID NO: | 1243) |
| 1554 | WFHSPSQYENL | 1409.6 | – | (SEQ ID NO: | 1244) |
| 1555 | WFYSPSQWENL | 1432.7 | – | (SEQ ID NO: | 1245) |
| 1557 | WFHSPSHPENL | 1352.6 | – | (SEQ ID NO: | 1246) |
| 1558 | WFFSPSHFENL | 1402.6 | – | (SEQ ID NO: | 1247) |
| 1559 | WFHSPSHYENL | 1418.6 | – | (SEQ ID NO: | 1248) |
| 1560 | WFHSPSHWENL | 1441.7 | – | (SEQ ID NO: | 1249) |
| 1562 | WFNSPSMPENL | 1323.7 | – | (SEQ ID NO: | 1250) |
| 1563 | WFNSPSMFENL | 1373.7 | – | (SEQ ID NO: | 1251) |
| 1564 | WFNSPSMYENL | 1389.7 | – | (SEQ ID NO: | 1252) |
| 1565 | WFNSPSMWENL | 1412.8 | – | (SEQ ID NO: | 1253) |
| 1567 | WFNSPSFPENL | 1339.6 | – | (SEQ ID NO: | 1254) |
| 1568 | WFNSPSFFENL | 1389.6 | – | (SEQ ID NO: | 1255) |
| 1569 | WFNSPSFYENL | 1405.6 | – | (SEQ ID NO: | 1256) |
| 1570 | WFNSPSFWENL | 1428.7 | – | (SEQ ID NO: | 1257) |
| 1572 | WFNSPSYPENL | 1355.6 | – | (SEQ ID NO: | 1258) |
| 1573 | WFNSPSYFENL | 1405.6 | – | (SEQ ID NO: | 1259) |
| 1574 | WFNSPSYYENL | 1421.6 | – | (SEQ ID NO: | 1260) |
| 1575 | WFNSPSYWENL | 1444.7 | – | (SEQ ID NO: | 1261) |
| 1577 | WFNSPSDPENL | 1307.5 | – | (SEQ ID NO: | 1262) |
| 1578 | WFNSPSDFENL | 1357.5 | – | (SEQ ID NO: | 1263) |
| 1579 | WFNSPSDYENL | 1373.5 | – | (SEQ ID NO: | 1264) |
| 1580 | WFNSPSDWENL | 1396.6 | – | (SEQ ID NO: | 1265) |
| 1582 | WFNSPSEPENL | 1321.5 | – | (SEQ ID NO: | 1266) |
| 1583 | WFNSPSEFENL | 1371.5 | – | (SEQ ID NO: | 1267) |
| 1584 | WFNSPSEYENL | 1387.5 | – | (SEQ ID NO: | 1268) |
| 1585 | WENSPSEWENL | 1410.6 | – | (SEQ ID NO: | 1269) |
| 1587 | WFNSPSNPENL | 1306.5 | – | (SEQ ID NO: | 1270) |
| 1588 | WFNSPSNFENL | 1356.6 | – | (SEQ ID NO: | 1271) |
| 1589 | WFNSPSNYENL | 1372.6 | – | (SEQ ID NO: | 1272) |
| 1590 | WFNSPSNWENL | 1395.7 | – | (SEQ ID NO: | 1273) |
| 1592 | WFNSPSQPENL | 1320.6 | – | (SEQ ID NO: | 1274) |
| 1593 | WFNSPSQFENL | 1370.6 | – | (SEQ ID NO: | 1275) |
| 1594 | WFNSPSQYENL | 1386.6 | – | (SEQ ID NO: | 1276) |
| 1595 | WFNSPSQWENL | 1409.7 | – | (SEQ ID NO: | 1277) |
| 1597 | WFNSPSHPENL | 1329.6 | – | (SEQ ID NO: | 1278) |
| 1598 | WFNSPSHFENL | 1379.6 | – | (SEQ ID NO: | 1279) |
| 1599 | WFNSPSHYENL | 1395.6 | – | (SEQ ID NO: | 1280) |
| 1600 | WFNSPSHWENL | 1418.7 | – | (SEQ ID NO: | 1281) |
| 1602 | WFGSPSMPENL | 1266.6 | – | (SEQ ID NO: | 1282) |
| 1603 | WFGSPSMFENL | 1316.6 | – | (SEQ ID NO: | 1283) |
| 1604 | WFGSPSMYENL | 1332.6 | – | (SEQ ID NO: | 1284) |
| 1605 | WFGSPSMWENL | 1355.7 | – | (SEQ ID NO: | 1285) |
| 1607 | WFGSPSFPENL | 1282.5 | – | (SEQ ID NO: | 1286) |
| 1608 | WFGSPSFFENL | 1332.5 | – | (SEQ ID NO: | 1287) |
| 1609 | WFGSPSFYENL | 1348.5 | – | (SEQ ID NO: | 1288) |
| 1610 | WFGSPSFWENL | 1371.6 | – | (SEQ ID NO: | 1289) |
| 1612 | WFGSPSYPENL | 1298.5 | – | (SEQ ID NO: | 1290) |
| 1613 | WFGSPSYFENL | 1348.5 | – | (SEQ ID NO: | 1291) |
| 1614 | WFGSPSYYENL | 1364.5 | – | (SEQ ID NO: | 1292) |
| 1615 | WFGSPSYWENL | 1387.6 | – | (SEQ ID NO: | 1293) |
| 1617 | WFGSPSDPENL | 1250.4 | – | (SEQ ID NO: | 1294) |
| 1618 | WFGSPSDFENL | 1300.4 | – | (SEQ ID NO: | 1295) |
| 1619 | WFGSPSDYENL | 1316.4 | – | (SEQ ID NO: | 1296) |
| 1620 | WFGSPSDWENL | 1339.5 | – | (SEQ ID NO: | 1297) |
| 1622 | WFGSPSEPENL | 1264.4 | – | (SEQ ID NO: | 1298) |
| 1623 | WFGSPSEFENL | 1314.4 | – | (SEQ ID NO: | 1299) |
| 1624 | WFGSPSEYENL | 1330.4 | – | (SEQ ID NO: | 1300) |
| 1625 | WFGSPSEWENL | 1353.5 | – | (SEQ ID NO: | 1301) |
| 1627 | WFGSPSNPENL | 1249.5 | – | (SEQ ID NO: | 1302) |
| 1628 | WFGSPSNFENL | 1299.5 | – | (SEQ ID NO: | 1303) |
| 1629 | WFGSPSNYENL | 1315.5 | – | (SEQ ID NO: | 1304) |
| 1630 | WFQSPSNWENL | 1338.6 | – | (SEQ ID NO: | 1305) |
| 1632 | WFGSPSQPENL | 1263.5 | – | (SEQ ID NO: | 1306) |
| 1633 | WFGSPSQFENL | 1313.5 | – | (SEQ ID NO: | 1307) |
| 1634 | WFGSPSQYENL | 1329.5 | – | (SEQ ID NO: | 1308) |
| 1635 | WFGSPSQWENL | 1352.6 | – | (SEQ ID NO: | 1309) |
| 1637 | WFGSPSHPENL | 1272.5 | – | (SEQ ID NO: | 1310) |
| 1638 | WFGSPSHFENL | 1322.5 | – | (SEQ ID NO: | 1311) |
| 1639 | WFGSPSHYENL | 1338.5 | – | (SEQ ID NO: | 1312) |
| 1640 | WFGSPSHWENL | 1361.6 | – | (SEQ ID NO: | 1313) |
| 1642 | WFASPSMPENL | 1280.6 | – | (SEQ ID NO: | 1314) |
| 1643 | WFASPSMFENL | 1330.6 | – | (SEQ ID NO: | 1315) |
| 1644 | WFASPSMYENL | 1346.6 | – | (SEQ ID NO: | 1316) |
| 1645 | WFASPSMWENL | 1369.7 | – | (SEQ ID NO: | 1317) |
| 1647 | WFASPSFPENL | 1296.5 | – | (SEQ ID NO: | 1318) |
| 1648 | WFASPSFFENL | 1346.5 | – | (SEQ ID NO: | 1319) |
| 1649 | WFASPSFYENL | 1362.5 | – | (SEQ ID NO: | 1320) |
| 1650 | WFASPSFWENL | 1385.6 | – | (SEQ ID NO: | 1321) |
| 1652 | WFASPSYPENL | 1312.5 | – | (SEQ ID NO: | 1322) |
| 1653 | WFASPSYFENL | 1362.5 | – | (SEQ ID NO: | 1323) |
| 1654 | WFASPSYYENL | 1378.5 | – | (SEQ ID NO: | 1324) |
| 1655 | WFASPSYWENL | 1401.6 | – | (SEQ ID NO: | 1325) |
| 1657 | WFASPSDPENL | 1264.4 | – | (SEQ ID NO: | 1326) |
| 1658 | WFASPSDFENL | 1314.4 | – | (SEQ ID NO: | 1327) |
| 1659 | WFASPSDYENL | 1330.4 | – | (SEQ ID NO: | 1328) |
| 1660 | WFASPSDWENL | 1353.5 | – | (SEQ ID NO: | 1329) |
| 1662 | WFASPSEPENL | 1278.4 | – | (SEQ ID NO: | 1330) |
| 1663 | WFASPSEFENL | 1328.4 | – | (SEQ ID NO: | 1331) |
| 1664 | WFASPSEYENL | 1344.4 | – | (SEQ ID NO: | 1332) |
| 1665 | WFASPSEWENL | 1367.5 | – | (SEQ ID NO: | 1333) |
| 1667 | WFASPSNPENL | 1263.5 | – | (SEQ ID NO: | 1334) |
| 1668 | WFASPSNFENL | 1313.5 | – | (SEQ ID NO: | 1335) |
| 1669 | WFASPSNYENL | 1329.5 | – | (SEQ ID NO: | 1336) |
| 1670 | WFASPSNWENL | 1352.6 | – | (SEQ ID NO: | 1337) |
| 1672 | WFASPSQPENL | 1277.5 | – | (SEQ ID NO: | 1338) |
| 1673 | WFASPSQFENL | 1327.5 | – | (SEQ ID NO: | 1339) |
| 1674 | WFASPSQYENL | 1343.5 | – | (SEQ ID NO: | 1340) |
| 1675 | WFASPSQWENL | 1366.6 | – | (SEQ ID NO: | 1341) |
| 1677 | WFASPSHPENL | 1286.5 | – | (SEQ ID NO: | 1342) |
| 1678 | WFASPSHFENL | 1336.6 | – | (SEQ ID NO: | 1343) |
| 1679 | WFASPSHYENL | 1352.5 | – | (SEQ ID NO: | 1344) |
| 1680 | WFASPSHWENL | 1375.6 | – | (SEQ ID NO: | 1345) |
| 1682 | MYRSPSMPENL | 1326.7 | – | (SEQ ID NO: | 1346) |
| 1683 | MYRSPSMFENL | 1376.7 | – | (SEQ ID NO: | 1347) |
| 1684 | MYRSPSMYENL | 1392.7 | – | (SEQ ID NO: | 1348) |
| 1685 | MYRSPSMWENL | 1415.8 | – | (SEQ ID NO: | 1349) |
| 1687 | MYRSPSFPENL | 1342.6 | – | (SEQ ID NO: | 1350) |
| 1688 | MYRSPSFFENL | 1392.6 | – | (SEQ ID NO: | 1351) |
| 1689 | MYRSPSFYENL | 1408.6 | – | (SEQ ID NO: | 1352) |
| 1690 | MYRSPSFWENL | 1431.7 | – | (SEQ ID NO: | 1353) |
| 1692 | MYRSPSYPENL | 1358.6 | – | (SEQ ID NO: | 1354) |
| 1693 | MYRSPSYFENL | 1408.6 | – | (SEQ ID NO: | 1355) |
| 1694 | MYRSPSYYENL | 1424.6 | – | (SEQ ID NO: | 1356) |

TABLE 1-continued

| | | | | | |
|---|---|---|---|---|---|
| 1695 | MYRSPSYWENL | 1447.7 | - | (SEQ ID NO: | 1357) |
| 1697 | MYRSPSDPENL | 1310.5 | - | (SEQ ID NO: | 1358) |
| 1698 | MYRSPSDFENL | 1360.5 | - | (SEQ ID NO: | 1359) |
| 1699 | MYRSPSDYENL | 1376.3 | - | (SEQ ID NO: | 1360) |
| 1700 | MYRSPSDWENL | 1399.6 | - | (SEQ ID NO: | 1361) |
| 1702 | MYRSPSEPENL | 1324.5 | - | (SEQ ID NO: | 1362) |
| 1703 | MYRSPSEFENL | 1374.5 | - | (SEQ ID NO: | 1363) |
| 1704 | MYRSPSEYENL | 1390.5 | - | (SEQ ID NO: | 1364) |
| 1705 | MYRSSENPENL | 1413.6 | - | (SEQ ID NO: | 1365) |
| 1707 | MYRSPSNPENL | 1309.6 | - | (SEQ ID NO: | 1366) |
| 1708 | MYRSPSNFENL | 1359.6 | - | (SEQ ID NO: | 1367) |
| 1709 | MYRSPSNYENL | 1375.6 | - | (SEQ 16 NO: | 1368) |
| 1710 | MYRSPSNWENL | 1398.7 | - | (SEQ ID NO: | 1369) |
| 1712 | MYRSPSQPENL | 1323.6 | - | (SEQ ID NO: | 1370) |
| 1713 | MYRSPSQFENL | 1373.6 | - | (SEQ ID NO: | 1371) |
| 1714 | MYRSPSQYENL | 1389.6 | - | (SEQ ID NO: | 1372) |
| 1715 | MYRSPSQWENL | 1412.7 | - | (SEQ ID NO: | 1373) |
| 1717 | MYRSPSHPENL | 1332.6 | - | (SEQ ID NO: | 1374) |
| 1718 | MYRSPSHFENL | 1382.6 | - | (SEQ ID NO: | 1375) |
| 1719 | MYRSPSHYENL | 1398.6 | - | (SEQ ID NO: | 1376) |
| 1720 | MYRSPSHWENL | 1421.7 | - | (SEQ ID NO: | 1377) |
| 1722 | MYSSPSMPENL | 1258.4 | - | (SEQ ID NO: | 1378) |
| 1723 | MYSSPSMFENL | 1308.4 | - | (SEQ ID NO: | 1379) |
| 1724 | MYSSPSMYENL | 1324.4 | - | (SEQ ID NO: | 1380) |
| 1725 | MYSSPSMWENL | 1347.5 | - | (SEQ ID NO: | 1381) |
| 1727 | MYSSPSFPENL | 1274.3 | - | (SEQ ID NO: | 1382) |
| 1728 | MYSSPSFFENL | 1324.3 | - | (SEQ ID NO: | 1383) |
| 1729 | MYSSPSFYENL | 1340.3 | - | (SEQ ID NO: | 1384) |
| 1730 | MYSSPSFWENL | 1363.4 | - | (SEQ ID NO: | 1385) |
| 1732 | MYSSPSYPENL | 1290.3 | - | (SEQ ID NO: | 1386) |
| 1733 | MYSSPSYFENL | 1340.3 | - | (SEQ ID NO: | 1387) |
| 1734 | MYSSPSYYENL | 1356.3 | - | (SEQ ID NO: | 1388) |
| 1735 | MYSSPSYWENL | 1379.4 | - | (SEQ ID NO: | 1389) |
| 1737 | MYSSPSDPENL | 1242.2 | - | (SEQ ID NO: | 1390) |
| 1738 | MYSSPSDFENL | 1292.2 | - | (SEQ ID NO: | 1391) |
| 1739 | MYSSPSDYENL | 1308.2 | - | (SEQ ID NO: | 1392) |
| 1740 | MYSSPSDWENL | 1331.3 | - | (SEQ ID NO: | 1393) |
| 1742 | MYSSPSEPENL | 1256.2 | - | (SEQ ID NO: | 1394) |
| 1743 | MYSSPSEFENL | 1306.2 | - | (SEQ ID NO: | 1395) |
| 1744 | MYSSPSEYENL | 1322.2 | - | (SEQ ID NO: | 1396) |
| 1745 | MYSSPSEWENL | 1345.3 | - | (SEQ ID NO: | 1397) |
| 1747 | MYSSPSNPENL | 1241.3 | - | (SEQ ID NO: | 1398) |
| 1748 | MYSSPSNFENL | 1291.3 | - | (SEQ ID NO: | 1399) |
| 1749 | MYSSPSNYENL | 1307.3 | - | (SEQ ID NO: | 1400) |
| 1750 | MYSSPSNWENL | 1330.4 | - | (SEQ ID NO: | 1401) |
| 1752 | MYSSPSQPENL | 1255.3 | - | (SEQ ID NO: | 1402) |
| 1753 | MYSSPSQFENL | 1305.3 | - | (SEQ ID NO: | 1403) |
| 1754 | MYSSPSQYENL | 1321.3 | - | (SEQ ID NO: | 1404) |
| 1755 | MYSSPSQWENL | 1344.4 | - | (SEQ ID NO: | 1405) |
| 1757 | MYSSPSHPENL | 1264.3 | - | (SEQ ID NO: | 1406) |
| 1758 | MYSSPSHFENL | 1314.3 | - | (SEQ ID NO: | 1407) |
| 1759 | MYSSPSHYENL | 1330.3 | - | (SEQ ID NO: | 1408) |
| 1760 | MYSSPSHWENL | 1353.4 | - | (SEQ ID NO: | 1409) |
| 1762 | MYTSPSMPENL | 1271.6 | - | (SEQ ID NO: | 1410) |
| 1763 | MYTSPSMFENL | 1321.6 | - | (SEQ ID NO: | 1411) |
| 1764 | MYTSPSMYENL | 1337.6 | - | (SEQ ID NO: | 1412) |
| 1765 | MYTSPSMWENL | 1360.7 | - | (SEQ ID NO: | 1413) |
| 1767 | MYTSPSFPENL | 1287.5 | - | (SEQ ID NO: | 1414) |
| 1768 | MYTSPSFFENL | 1337.5 | - | (SEQ ID NO: | 1415) |
| 1769 | MYTSPSFYENL | 1353.5 | - | (SEQ ID NO: | 1416) |
| 1770 | MYTSPSFWENL | 1376.6 | - | (SEQ ID NO: | 1417) |
| 1772 | MYTSPSYPENL | 1303.5 | - | (SEQ ID NO: | 1418) |
| 1773 | MYTSPSYFENL | 1353.5 | - | (SEQ ID NO: | 1419) |
| 1774 | MYTSPSYYENL | 1369.5 | - | (SEQ ID NO: | 1420) |
| 1775 | MYTSPSYWENL | 1392.6 | - | (SEQ ID NO: | 1421) |
| 1777 | MYTSPSDPENL | 1255.4 | - | (SEQ ID NO: | 1422) |
| 1778 | MYTSPSDFENL | 1305.4 | - | (SEQ ID NO: | 1423) |
| 1779 | MYTSPSDYENL | 1321.4 | - | (SEQ ID NO: | 1424) |
| 1780 | MYTSPSDWENL | 1344.5 | - | (SEQ ID NO: | 1425) |
| 1782 | MYTSPSEPENL | 1269.4 | - | (SEQ ID NO: | 1426) |
| 1783 | MYTSPSEFENL | 1319.4 | - | (SEQ ID NO: | 1427) |
| 1784 | MYTSPSEYENL | 1335.4 | - | (SEQ ID NO: | 1428) |
| 1785 | MYTSPSEWENL | 1358.5 | - | (SEQ ID NO: | 1429) |
| 1787 | MYTSPSNPENL | 1254.5 | - | (SEQ ID NO: | 1430) |
| 1788 | MYTSPSNFENL | 1304.5 | - | (SEQ ID NO: | 1431) |
| 1789 | MYTSPSNYENL | 1320.5 | - | (SEQ ID NO: | 1432) |
| 1790 | MYTSPSNWENL | 1343.6 | - | (SEQ ID NO: | 1433) |
| 1792 | MYTSPSQPENL | 1268.5 | - | (SEQ ID NO: | 1434) |
| 1793 | MYTSPSQFENL | 1318.5 | - | (SEQ ID NO: | 1435) |
| 1794 | MYTSPSQYENL | 1334.5 | - | (SEQ ID NO: | 1436) |
| 1795 | MYTSPSQWENL | 1357.6 | - | (SEQ ID NO: | 1437) |
| 1797 | MYTSPSEPENL | 1277.5 | - | (SEQ ID No: | 1438) |
| 1798 | MYTSPSHFENL | 1327.5 | - | (SEQ ID NO: | 1439) |
| 1799 | MYTSPSHYENL | 1343.5 | - | (SEQ ID NO: | 1440) |
| 1800 | MYTSPSHWENL | 1366.6 | - | (SEQ ID NO: | 1441) |
| 1802 | MYHSPSMPENL | 1307.7 | - | (SEQ ID NO: | 1442) |
| 1803 | MYHSPSMFENL | 1357.7 | - | (SEQ ID NO: | 1443) |
| 1804 | MYHSPSMYENL | 1373.7 | - | (SEQ ID No: | 1444) |
| 1805 | MYHSPSMWENL | 1396.8 | - | (SEQ ID NO: | 1445) |
| 1807 | MYHSPSFPENL | 1323.6 | - | (SEQ ID NO: | 1446) |
| 1808 | MYHSPSFFENL | 1373.6 | - | (SEQ ID NO: | 1447) |
| 1809 | MYHSTSFYENL | 1389.6 | - | (SEQ ID NO: | 1448) |
| 1810 | MYHSPSFWENL | 1412.7 | - | (SEQ ID NO: | 1449) |
| 1812 | MYHSPSYPENL | 1339.6 | - | (SEQ ID NO: | 1450) |
| 1813 | MYHSPSYFENL | 1389.6 | - | (SEQ ID NO: | 1451) |
| 1814 | MYHSPSYYENL | 1405.6 | - | (SEQ ID NO: | 1452) |
| 1815 | MYHSPSYWENL | 1428.7 | - | (SEQ ID NO: | 1453) |
| 1817 | MYHSPSDPENL | 1291.5 | - | (SEQ ID NO: | 1454) |
| 1818 | MYHSPSDFENL | 1341.5 | - | (SEQ ID NO: | 1455) |
| 1819 | MYHSPSDYENL | 1357.5 | - | (SEQ ID NO: | 1456) |
| 1820 | MYHSPSDWENL | 1380.6 | - | (SEQ ID NO: | 1457) |
| 1822 | MYHSPSEPENL | 1305.5 | - | (SEQ ID NO: | 1458) |
| 1823 | MYHSPSEFENL | 1355.5 | - | (SEQ ID NO: | 1459) |
| 1824 | MYHSPSEYENL | 1371.5 | - | (SEQ ID NO: | 1460) |
| 1825 | MYHSPSEWENL | 1394.6 | - | (SEQ ID NO: | 1461) |
| 1827 | MYHSPSNPENL | 1290.6 | - | (SEQ ID NO: | 1462) |
| 1828 | MYHSPSNFENL | 1340.6 | - | (SEQ ID NO: | 1463) |
| 1829 | MYHSPSNYENL | 1356.6 | - | (SEQ ID NO: | 1464) |
| 1830 | MYHSPSNWENL | 1379.7 | - | (SEQ ID NO: | 1465) |
| 1832 | MYHSPSQPENL | 1304.6 | - | (SEQ ID NO: | 1466) |
| 1833 | MYHSPSQFENL | 1354.6 | - | (SEQ ID NO: | 1467) |
| 1834 | MYHSPSQYENL | 1370.6 | - | (SEQ ID NO: | 1468) |
| 1835 | MYHSPSQWENL | 1393.7 | - | (SEQ ID NO: | 1469) |
| 1837 | MYHSPSHPENL | 1313.6 | - | (SEQ ID NO: | 1470) |
| 1838 | MYHSPSHFENL | 1363.6 | - | (SEQ ID NO: | 1471) |
| 1839 | MYHSPSHYENL | 1379.6 | - | (SEQ ID NO: | 1472) |
| 1840 | MYHSPSHWENL | 1402.7 | - | (SEQ ID NO: | 1473) |
| 1842 | MYNSPSMPENL | 1284.7 | - | (SEQ ID NO: | 1474) |
| 1843 | MYNSPSMFENL | 1334.7 | - | (SEQ ID NO: | 1475) |
| 1844 | MYNSPSMYENL | 1350.7 | - | (SEQ ID NO: | 1476) |
| 1845 | MYNSPSMWENL | 1373.8 | - | (SEQ ID NO: | 1477) |
| 1847 | MYNSPSFPENL | 1300.6 | - | (SEQ ID NO: | 1478) |
| 1848 | MYNSPSFFENL | 1350.6 | - | (SEQ ID NO: | 1479) |
| 1849 | MYNSPSFYENL | 1366.6 | - | (SEQ ID NO: | 1480) |
| 1850 | MYNSPSFWENL | 1389.7 | - | (SEQ ID NO: | 1481) |
| 1852 | MYNSPSYPENL | 1316.6 | - | (SEQ ID NO: | 1482) |
| 1853 | MYNSPSYFENL | 1366.6 | - | (SEQ ID NO: | 1483) |
| 1854 | MYNSPSYYENL | 1382.6 | - | (SEQ ID NO: | 1484) |
| 1855 | MYNSPSYWENL | 1405.7 | - | (SEQ ID NO: | 1485) |
| 1857 | MYNSPSDPENL | 1268.5 | - | (SEQ ID NO: | 1486) |
| 1858 | MYNSPSDFENL | 1318.5 | - | (SEQ ID NO: | 1487) |
| 1859 | MYNSPSDYENL | 1334.5 | - | (SEQ ID NO: | 1488) |
| 1860 | MYNSPSDWENL | 1357.6 | - | (SEQ ID NO: | 1489) |
| 1862 | MYNSPSEPENL | 1282.5 | - | (SEQ ID NO: | 1490) |
| 1863 | MYNSPSEFENL | 1332.5 | - | (SEQ ID NO: | 1491) |
| 1864 | MYNSPSEYENL | 1348.5 | - | (SEQ ID NO: | 1492) |
| 1865 | MYNSPSEWENL | 1371.6 | - | (SEQ ID NO: | 1493) |
| 1867 | MYNSPSNPENL | 1267.6 | - | (SEQ ID NO: | 1494) |
| 1868 | MYNSPSNFENL | 1317.6 | - | (SEQ ID NO: | 1495) |
| 1869 | MYNSPSNYENL | 1333.6 | - | (SEQ ID NO: | 1496) |
| 1870 | MYNSPSNWENL | 1356.7 | - | (SEQ ID NO: | 1497) |
| 1872 | MYNSPSQPENL | 1281.6 | - | (SEQ ID NO: | 1498) |
| 1873 | MYNSPSQFENL | 1331.6 | - | (SEQ ID NO: | 1499) |
| 1874 | MYNSPSQYENL | 1347.6 | - | (SEQ ID NO: | 1500) |
| 1875 | MYNSPSQWENL | 1370.7 | - | (SEQ ID NO: | 1501) |
| 1877 | MYNSPSHPENL | 1290.6 | - | (SEQ ID NO: | 1502) |
| 1878 | MYNSPSHFENL | 1340.6 | - | (SEQ ID NO: | 1503) |
| 1879 | MYNSPSHYENL | 1356.6 | - | (SEQ ID NO: | 1504) |
| 1880 | MYNSPSHWENL | 1379.7 | - | (SEQ ID NO: | 1505) |
| 1882 | MYGSPSMPENL | 1227.6 | - | (SEQ ID NO: | 1506) |
| 1883 | MYGSPSMFENL | 1277.6 | - | (SEQ ID NO: | 1507) |
| 1884 | MYGSPSMYENL | 1293.6 | - | (SEQ ID NO: | 1508) |
| 1885 | MYGSPSMWENL | 1316.7 | - | (SEQ ID NO: | 1509) |
| 1887 | MYGSPSFPENL | 1243.5 | - | (SEQ ID NO: | 1510) |
| 1888 | MYGSPSFFENL | 1293.5 | - | (SEQ ID NO: | 1511) |
| 1889 | MYGSPSFYENL | 1309.5 | - | (SEQ ID NO: | 1512) |
| 1890 | MYGSPSFWENL | 1332.6 | - | (SEQ ID NO: | 1513) |
| 1892 | MYGSPSYPENL | 1259.5 | - | (SEQ ID NO: | 1514) |

TABLE 1-continued

| | | | | |
|---|---|---|---|---|
| 1893 | MYGSPSYFENL | 1309.5 | - | (SEQ ID NO: 1515) |
| 1894 | MYGSPSYYENL | 1325.5 | - | (SEQ ID NO: 1516) |
| 1895 | MYGSPSYWENL | 1348.6 | - | (SEQ ID NO: 1517) |
| 1897 | MYGSPSDPENL | 1211.4 | - | (SEQ ID NO: 1518) |
| 1898 | MYGSPSDFENL | 1261.4 | - | (SEQ ID NO: 1519) |
| 1899 | MYGSPSDYENL | 1277.4 | - | (SEQ ID NO: 1520) |
| 1900 | MYGSPSDWENL | 1300.5 | - | (SEQ ID NO: 1521) |
| 1902 | MYGSPSEPENL | 1225.4 | - | (SEQ ID NO: 1522) |
| 1903 | MYGSPSEFENL | 1275.4 | - | (SEQ ID NO: 1523) |
| 1904 | MYGSPSEYENL | 1291.4 | - | (SEQ ID NO: 1524) |
| 1905 | MYGSPSEWENL | 1314.5 | - | (SEQ ID NO: 1525) |
| 1907 | MYGSPSNPENL | 1210.5 | - | (SEQ ID NO: 1526) |
| 1908 | MYGSPSNFENL | 1260.5 | - | (SEQ ID NO: 1527) |
| 1909 | MYGSPSNYENL | 1276.5 | - | (SEQ ID NO: 1528) |
| 1910 | MYGSPSNWENL | 1299.6 | - | (SEQ ID NO: 1529) |
| 1912 | MYGSPSQPENL | 1224.5 | - | (SEQ ID NO: 1530) |
| 1913 | MYGSPSQFENL | 1274.5 | - | (SEQ ID NO: 1531) |
| 1914 | MYGSPSQYENL | 1290.5 | - | (SEQ ID NO: 1532) |
| 1915 | MYGSPSQWENL | 1313.6 | - | (SEQ ID NO: 1533) |
| 1917 | MYGSPSHPENL | 1233.5 | - | (SEQ ID NO: 1534) |
| 1918 | MYGSPSHFENL | 1283.5 | - | (SEQ ID NO: 1535) |
| 1919 | MYGSPSHYENL | 1299.5 | - | (SEQ ID NO: 1536) |
| 1920 | MYGSPSHWENL | 1322.6 | - | (SEQ ID NO: 1537) |
| 1922 | MYASPSMPENL | 1241.6 | - | (SEQ ID NO: 1538) |
| 1923 | MYASPSMFENL | 1291.6 | - | (SEQ ID NO: 1539) |
| 1924 | MYASPSMYENL | 1307.6 | - | (SEQ ID NO: 1540) |
| 1925 | MYASPSMWENL | 1330.7 | - | (SEQ ID NO: 1541) |
| 1927 | MYASPSFPENL | 1257.5 | - | (SEQ ID NO: 1542) |
| 1928 | MYASPSFFENL | 1307.5 | - | (SEQ ID NO: 1543) |
| 1929 | MYASPSFYENL | 1323.5 | - | (SEQ ID NO: 1544) |
| 1930 | MYASPSFWENL | 1346.6 | - | (SEQ ID NO: 1545) |
| 1932 | MYASPSYPENL | 1273.5 | - | (SEQ ID NO: 1546) |
| 1933 | MYASPSYFENL | 1323.5 | - | (SEQ ID NO: 1547) |
| 1934 | MYASPSYYENL | 1339.5 | - | (SEQ ID NO: 1548) |
| 1935 | MYASPSYWENL | 1362.6 | - | (SEQ ID NO: 1549) |
| 1937 | MYASPSDPENL | 1225.4 | - | (SEQ ID NO: 1550) |
| 1938 | MYASPSDFENL | 1275.4 | - | (SEQ ID NO: 1551) |
| 1939 | MYASPSDYENL | 1291.4 | - | (SEQ ID NO: 1552) |
| 1940 | MYASPSDWENL | 1314.5 | - | (SEQ ID NO: 1553) |
| 1942 | MYASPSEPENL | 1239.4 | - | (SEQ ID NO: 1554) |
| 1943 | MYASPSEFENL | 1289.4 | - | (SEQ ID NO: 1555) |
| 1944 | MYASPSEYENL | 1305.4 | - | (SEQ ID NO: 1556) |
| 1945 | MYASPSEWENL | 1328.5 | - | (SEQ ID NO: 1557) |
| 1947 | MYASPSNPENL | 1224.5 | - | (SEQ ID NO: 1558) |
| 1948 | MYASPSNFENL | 1274.5 | - | (SEQ ID NO: 1559) |
| 1949 | MYASPSNYENL | 1290.5 | - | (SEQ ID NO: 1560) |
| 1950 | MYASPSNWENL | 1313.6 | - | (SEQ ID NO: 1561) |
| 1952 | MYASPSQPENL | 1238.5 | - | (SEQ ID NO: 1562) |
| 1953 | MYASPSQFENL | 1288.5 | - | (SEQ ID NO: 1563) |
| 1954 | MYASPSQYENL | 1304.5 | - | (SEQ ID NO: 1564) |
| 1955 | MYASPSQWENL | 1327.6 | - | (SEQ ID NO: 1565) |
| 1957 | MYASPSHPENL | 1247.5 | - | (SEQ ID NO: 1566) |
| 1958 | MYASPSHFENL | 1297.5 | - | (SEQ ID NO: 1567) |
| 1959 | MYASPSHYENL | 1313.5 | - | (SEQ ID NO: 1568) |
| 1960 | MYASPSHWENL | 1336.6 | - | (SEQ ID NO: 1569) |
| 1962 | MFRSPSMPENL | 1310.7 | - | (SEQ ID NO: 1570) |
| 1963 | MFRSPSMFENL | 1360.7 | - | (SEQ ID NO: 1571) |
| 1964 | MFRSPSMYENL | 1376.7 | - | (SEQ ID NO: 1572) |
| 1965 | MFRSPSMWENL | 1399.8 | - | (SEQ ID NO: 1573) |
| 1967 | MFRSPSFPENL | 1326.6 | - | (SEQ ID NO: 1574) |
| 1968 | MFRSPSFFENL | 1376.6 | - | (SEQ ID NO: 1575) |
| 1969 | MFRSPSFYENL | 1392.6 | - | (SEQ ID NO: 1576) |
| 1970 | MFRSPSFWENL | 1415.7 | - | (SEQ ID NO: 1577) |
| 1972 | MFRSPSYPENL | 1342.6 | - | (SEQ ID NO: 1578) |
| 1973 | MFRSPSYFENL | 1392.6 | - | (SEQ ID NO: 1579) |
| 1974 | MFRSPSYYENL | 1408.6 | - | (SEQ ID NO: 1580) |
| 1975 | MFRSPSYWENL | 1431.7 | - | (SEQ ID NO: 1581) |
| 1977 | MFRSPSDPENL | 1294.5 | - | (SEQ ID NO: 1582) |
| 1978 | MFRSPSDFENL | 1344.5 | - | (SEQ ID NO: 1583) |
| 1979 | MFRSPSDYENL | 1360.5 | - | (SEQ ID NO: 1584) |
| 1980 | MFRSPSDWENL | 1383.6 | - | (SEQ ID NO: 1585) |
| 1982 | MFRSPSEPENL | 1308.5 | - | (SEQ ID NO: 1586) |
| 1983 | MFRSPSEFENL | 1358.5 | - | (SEQ ID NO: 1587) |
| 1984 | MFRSPSEYENL | 1374.5 | - | (SEQ ID NO: 1588) |
| 1985 | MFRSPSEWENL | 1397.6 | - | (SEQ ID NO: 1589) |
| 1987 | MFRSPSNPENL | 1293.5 | - | (SEQ ID NO: 1590) |
| 1988 | MFRSPSNFENL | 1343.6 | - | (SEQ ID NO: 1591) |
| 1989 | MFRSPSNYENL | 1359.6 | - | (SEQ ID NO: 1592) |
| 1990 | MFRSPSNWENL | 1382.7 | - | (SEQ ID NO: 1593) |
| 1992 | MFRSPSQPENL | 1307.6 | - | (SEQ ID NO: 1594) |
| 1993 | MFRSPSQFENL | 1357.6 | - | (SEQ ID NO: 1595) |
| 1994 | MFRSPSQYETL | 1373.6 | - | (SEQ ID NO: 1596) |
| 1995 | MFRSPSQWENL | 1396.7 | - | (SEQ ID NO: 1597) |
| 1997 | MFRSPSHPENL | 1316.6 | - | (SEQ ID NO: 1598) |
| 1998 | MFRSPSHFENL | 1366.6 | - | (SEQ ID NO: 1599) |
| 1999 | MFRSPSHYENL | 1382.6 | - | (SEQ ID NO: 1600) |
| 2000 | MFRSPSHWENL | 1405.7 | - | (SEQ ID NO: 1601) |
| 2002 | MFSSPSMPENL | 1242.4 | - | (SEQ ID NO: 1602) |
| 2003 | MFSSPSMFENL | 1292.4 | - | (SEQ ID NO: 1603) |
| 2004 | MFSSPSMYENL | 1308.4 | - | (SEQ ID NO: 1604) |
| 2005 | MFSSPSMWENL | 1331.5 | - | (SEQ ID NO: 1605) |
| 2007 | MFSSPSFPENL | 1258.3 | - | (SEQ ID NO: 1606) |
| 2008 | MFSSPSFFENL | 1308.3 | - | (SEQ ID NO: 1607) |
| 2009 | MFSSPSFYENL | 1324.3 | - | (SEQ ID NO: 1608) |
| 2010 | MFSSPSFWENL | 1347.4 | - | (SEQ ID NO: 1609) |
| 2012 | MFSSPSYPENL | 1274.3 | - | (SEQ ID NO: 1610) |
| 2013 | MFSSPSYFENL | 1324.3 | - | (SEQ ID NO: 1611) |
| 2014 | MFSSPSYYENL | 1340.3 | - | (SEQ ID NO: 1612) |
| 2015 | MFSSPSYWENL | 1363.4 | - | (SEQ ID NO: 1613) |
| 2017 | MFSSPSDPENL | 1226.2 | - | (SEQ ID NO: 1614) |
| 2018 | MFSSPSDFENL | 1276.2 | - | (SEQ ID NO: 1615) |
| 2019 | MFSSPSDYENL | 1292.2 | - | (SEQ ID NO: 1616) |
| 2020 | MFSSPSDWENL | 1315.3 | - | (SEQ ID NO: 1617) |
| 2022 | MFSSPSEPENL | 1240.2 | - | (SEQ ID NO: 1618) |
| 2023 | MFSSPSEFENL | 1290.2 | - | (SEQ ID NO: 1619) |
| 2024 | MFSSPSEYENL | 1306.2 | - | (SEQ ID NO: 1620) |
| 2025 | MFSSPSEWENL | 1329.3 | - | (SEQ ID NO: 1621) |
| 2027 | MFSSPSNPENL | 1225.3 | - | (SEQ ID NO: 1622) |
| 2028 | MFSSPSNFENL | 1275.3 | - | (SEQ ID NO: 1623) |
| 2029 | MFSSPSNYENL | 1291.3 | - | (SEQ ID NO: 1624) |
| 2030 | MFSSPSNWENL | 1314.4 | - | (SEQ ID NO: 1625) |
| 2032 | MFSSPSQPENL | 1239.3 | - | (SEQ ID NO: 1626) |
| 2033 | MFSSPSQFENL | 1289.3 | - | (SEQ ID NO: 1627) |
| 2034 | MFSSPSQYENL | 1305.3 | - | (SEQ ID NO: 1628) |
| 2035 | MFSSPSQWENL | 1328.4 | - | (SEQ ID NO: 1629) |
| 2037 | MFSSPSHPENL | 1248.3 | - | (SEQ ID NO: 1630) |
| 2038 | MFSSPSHFENL | 1298.3 | - | (SEQ ID NO: 1631) |
| 2039 | MFSSPSHYENL | 1314.3 | - | (SEQ ID NO: 1632) |
| 2040 | MFSSPSHWENL | 1337.4 | - | (SEQ ID NO: 1633) |
| 2042 | MFTSPSMPENL | 1255.6 | - | (SEQ ID NO: 1634) |
| 2043 | MFTSPSMFENL | 1305.6 | - | (SEQ ID NO: 1635) |
| 2044 | MFTSPSMYENL | 1321.6 | - | (SEQ ID NO: 1636) |
| 2045 | MFTSPSMWENL | 1344.7 | - | (SEQ ID NO: 1637) |
| 2047 | MFTSPSFPENL | 1271.5 | - | (SEQ ID NO: 1638) |
| 2048 | MFTSPSFFENL | 1321.5 | - | (SEQ ID NO: 1639) |
| 2049 | MFTSPSFYENL | 1337.5 | - | (SEQ ID NO: 1640) |
| 2050 | MFTSPSFWENL | 1360.6 | - | (SEQ ID NO: 1641) |
| 2052 | MFTSPSYPENL | 1287.5 | - | (SEQ ID NO: 1642) |
| 2053 | MFTSPSYFENL | 1337.5 | - | (SEQ ID NO: 1643) |
| 2054 | MFTSPSYYENL | 1353.5 | - | (SEQ ID NO: 1644) |
| 2055 | MFTSPSYWENL | 1376.6 | - | (SEQ ID NO: 1645) |
| 2057 | MFTSPSDPENL | 1239.4 | - | (SEQ ID NO: 1646) |
| 2058 | MFTSPSDFENL | 1289.4 | - | (SEQ ID NO: 1647) |
| 2059 | MFTSPSDYENL | 1305.4 | - | (SEQ ID NO: 1648) |
| 2060 | MFTSPSDWENL | 1328.5 | - | (SEQ ID NO: 1649) |
| 2062 | MFTSPSEPENL | 1253.4 | - | (SEQ ID NO: 1650) |
| 2063 | MFTSPSEFENL | 1303.4 | - | (SEQ ID NO: 1651) |
| 2064 | MFTSPSEYENL | 1319.4 | - | (SEQ ID NO: 1652) |
| 2065 | MFTSPSEWENL | 1342.5 | - | (SEQ ID NO: 1653) |
| 2067 | MFTSPSNPENL | 1238.5 | - | (SEQ ID NO: 1654) |
| 2068 | MFTSPSNFENL | 1288.5 | - | (SEQ ID NO: 1655) |
| 2069 | MFTSPSNYENL | 1304.5 | - | (SEQ ID NO: 1656) |
| 2070 | MFTSPSNWENL | 1327.6 | - | (SEQ ID NO: 1657) |
| 2072 | MFTSPSQPENL | 1252.5 | - | (SEQ ID NO: 1658) |
| 2073 | MFTSPSQFENL | 1302.5 | - | (SEQ ID NO: 1659) |
| 2074 | MFTSPSQYENL | 1318.5 | - | (SEQ ID NO: 1660) |
| 2075 | MFTSPSQWENL | 1341.6 | - | (SEQ ID NO: 1661) |
| 2077 | MFTSPSHPENL | 1261.5 | - | (SEQ ID NO: 1662) |
| 2078 | MFTSPSHFENL | 1311.5 | - | (SEQ ID NO: 1663) |
| 2079 | MFTSPSHYENL | 1327.5 | - | (SEQ ID NO: 1664) |
| 2080 | MFTSPSHWENL | 1350.6 | - | (SEQ ID NO: 1665) |
| 2082 | MFHSPSMPENL | 1291.7 | - | (SEQ ID NO: 1666) |
| 2083 | MFHSPSMFENL | 1341.7 | - | (SEQ ID NO: 1667) |
| 2084 | MFHSPSMYENL | 1357.7 | - | (SEQ ID NO: 1668) |
| 2085 | MFHSPSMWENL | 1380.8 | - | (SEQ ID NO: 1669) |
| 2087 | MFHSPSFPENL | 1307.6 | - | (SEQ ID NO: 1670) |
| 2088 | MFHSPSFFENL | 1357.6 | - | (SEQ ID NO: 1671) |
| 2089 | MFHSPSFYENL | 1373.6 | - | (SEQ ID NO: 1672) |

TABLE 1-continued

| | | | | |
|---|---|---|---|---|
| 2090 | MFHSPSFWENL | 1396.7 | - | (SEQ ID NO: 1673) |
| 2092 | MFHSPSYPENL | 1323.6 | - | (SEQ ID NO: 1674) |
| 2093 | MFHSPSYFENL | 1373.6 | - | (SEQ ID NO: 1675) |
| 2094 | MFHSPSYYENL | 1389.6 | - | (SEQ ID NO: 1676) |
| 2095 | MFHSPSYWENL | 1412.7 | - | (SEQ ID NO: 1677) |
| 2097 | MFHSPSDPENL | 1275.5 | - | (SEQ ID NO: 1678) |
| 2098 | MFHSPSDFENL | 1325.5 | - | (SEQ ID NO: 1679) |
| 2099 | MFHSPSDYENL | 1341.5 | - | (SEQ ID NO: 1680) |
| 2100 | MFHSPSDWENL | 1364.6 | - | (SEQ ID NO: 1681) |
| 2102 | MFHSPSEPENL | 1289.5 | - | (SEQ ID NO: 1682) |
| 2103 | MFHSPSEFENL | 1339.5 | - | (SEQ ID NO: 1683) |
| 2104 | MFHSPSEYENL | 1355.5 | - | (SEQ ID NO: 1684) |
| 2105 | MFHSPSEWENL | 1378.6 | - | (SEQ ID NO: 1685) |
| 2107 | MFHSPSNPENL | 1274.6 | - | (SEQ ID NO: 1686) |
| 2108 | MFHSPSNFENL | 1324.6 | - | (SEQ ID NO: 1687) |
| 2109 | MFHSPSNYENL | 1340.6 | - | (SEQ ID NO: 1688) |
| 2110 | MFHSPSNWENL | 1363.7 | - | (SEQ ID NO: 1689) |
| 2112 | MFHSPSQPENL | 1288.6 | - | (SEQ ID NO: 1690) |
| 2113 | MFHSPSQFENL | 1338.6 | - | (SEQ ID NO: 1691) |
| 2114 | MFHSPSQYENL | 1354.6 | - | (SEQ ID NO: 1692) |
| 2115 | MFHSPSQWENL | 1377.7 | - | (SEQ ID NO: 1693) |
| 2117 | MFHSPSHPENL | 1297.6 | - | (SEQ ID NO: 1694) |
| 2118 | MFHSPSHFENL | 1347.6 | - | (SEQ ID NO: 1695) |
| 2119 | MFHSPSHYENL | 1363.6 | - | (SEQ ID NO: 1696) |
| 2120 | MFHSPSHWENL | 1386.7 | - | (SEQ ID NO: 1697) |
| 2122 | MFNSPSMPENL | 1268.7 | - | (SEQ ID NO: 1698) |
| 2123 | MFNSPSMFENL | 1318.7 | - | (SEQ ID NO: 1699) |
| 2124 | MFNSPSMYENL | 1334.7 | - | (SEQ ID NO: 1700) |
| 2125 | MFNSPSMWENL | 1357.8 | - | (SEQ ID NO: 1701) |
| 2127 | MFNSPSFPENL | 1284.6 | - | (SEQ ID NO: 1702) |
| 2128 | MFNSPSFFENL | 1334.6 | - | (SEQ ID NO: 1703) |
| 2129 | MFNSPSFYENL | 1350.6 | - | (SEQ ID NO: 1704) |
| 2130 | MFNSPSFWENL | 1373.7 | - | (SEQ ID NO: 1705) |
| 2132 | MFNSPSYPENL | 1300.6 | - | (SEQ ID NO: 1706) |
| 2133 | MFNSPSYFENL | 1350.6 | - | (SEQ ID NO: 1707) |
| 2134 | MFNSPSYYENL | 1366.6 | - | (SEQ ID NO: 1708) |
| 2135 | MFNSPSYWENL | 1389.7 | - | (SEQ ID NO: 1709) |
| 2137 | MFNSPSDPENL | 1252.5 | - | (SEQ ID NO: 1710) |
| 2138 | MFNSPSDFENL | 1302.5 | - | (SEQ ID NO: 1711) |
| 2139 | MFNSPSDYENL | 1318.5 | - | (SEQ ID NO: 1712) |
| 2140 | MFNSPSDWENL | 1341.6 | - | (SEQ ID NO: 1713) |
| 2142 | MFNSPSEPENL | 1266.5 | - | (SEQ ID NO: 1714) |
| 2143 | MFNSPSEFENL | 1316.5 | - | (SEQ ID NO: 1715) |
| 2144 | MFNSPSEYENL | 1332.5 | - | (SEQ ID NO: 1716) |
| 2145 | MFNSPSEWENL | 1355.6 | - | (SEQ ID NO: 1717) |
| 2147 | MFNSPSNPENL | 1251.6 | - | (SEQ ID NO: 1718) |
| 2148 | MFNSPSNFENL | 1301.6 | - | (SEQ ID NO: 1719) |
| 2149 | MFNSPSNYENL | 1317.6 | - | (SEQ ID NO: 1720) |
| 2150 | MFNSPSNWENL | 1340.7 | - | (SEQ ID NO: 1721) |
| 2152 | MFNSPSQPENL | 1265.6 | - | (SEQ ID NO: 1722) |
| 2153 | MFNSPSQFENL | 1315.6 | - | (SEQ ID NO: 1723) |
| 2154 | MFNSPSQYENL | 1331.6 | - | (SEQ ID NO: 1724) |
| 2155 | MFNSPSQWENL | 1354.7 | - | (SEQ ID NO: 1725) |
| 2157 | MFNSPSHPENL | 1274.6 | - | (SEQ ID NO: 1726) |
| 2158 | MFNSPSHFENL | 1324.6 | - | (SEQ ID NO: 1727) |
| 2159 | MFNSPSHYENL | 1340.6 | - | (SEQ ID NO: 1728) |
| 2160 | MFNSPSHWENL | 1363.7 | - | (SEQ ID NO: 1729) |
| 2162 | MFGSPSMPENL | 1211.6 | - | (SEQ ID NO: 1730) |
| 2163 | MFGSPSMFENL | 1261.6 | - | (SEQ ID NO: 1731) |
| 2164 | MFGSPSMYENL | 1277.6 | - | (SEQ ID NO: 1732) |
| 2165 | MFGSPSMWENL | 1300.7 | - | (SEQ ID NO: 1733) |
| 2167 | MFGSPSFPENL | 1227.5 | - | (SEQ ID NO: 1734) |
| 2168 | MFGSPSFFENL | 1277.5 | - | (SEQ ID NO: 1735) |
| 2169 | MFGSPSFYENL | 1293.5 | - | (SEQ ID NO: 1736) |
| 2170 | MFGSPSFWENL | 1316.6 | - | (SEQ ID NO: 1737) |
| 2172 | MFGSPSYPENL | 1243.5 | - | (SEQ ID NO: 1738) |
| 2173 | MFGSPSYFENL | 1293.5 | - | (SEQ ID NO: 1739) |
| 2174 | MFGSPSYYENL | 1309.5 | - | (SEQ ID NO: 1740) |
| 2175 | MFGSPSYWENL | 1332.6 | - | (SEQ ID NO: 1741) |
| 2177 | MFGSPSDPENL | 1195.4 | - | (SEQ ID NO: 1742) |
| 2178 | MFGSPSDFENL | 1245.4 | - | (SEQ ID NO: 1743) |
| 2179 | MFGSPSDYENL | 1261.4 | - | (SEQ ID NO: 1744) |
| 2180 | MFGSPSDWENL | 1284.5 | - | (SEQ ID NO: 1745) |
| 2182 | MFGSPSEPENL | 1209.4 | - | (SEQ ID NO: 1746) |
| 2183 | MFGSPSEFENL | 1259.4 | - | (SEQ ID NO: 1747) |
| 2184 | MFGSPSEYENL | 1275.4 | - | (SEQ ID NO: 1748) |
| 2185 | MFGSPSEWENL | 1298.5 | - | (SEQ ID NO: 1749) |
| 2187 | MFGSPSNPENL | 1194.5 | - | (SEQ ID NO: 1750) |
| 2188 | MFGSPSNFENL | 1244.5 | - | (SEQ ID NO: 1751) |
| 2189 | MFGSPSNYENL | 1260.5 | - | (SEQ ID NO: 1752) |
| 2190 | MFGSPSNWENL | 1283.6 | - | (SEQ ID NO: 1753) |
| 2192 | MFGSPSQPENL | 1208.5 | - | (SEQ ID NO: 1754) |
| 2193 | MFGSPSQFENL | 1258.5 | - | (SEQ ID NO: 1755) |
| 2194 | MFGSPSQYENL | 1274.5 | - | (SEQ ID NO: 1756) |
| 2195 | MFGSPSQWENL | 1297.6 | - | (SEQ ID NO: 1757) |
| 2197 | MFGSPSHPENL | 1217.5 | - | (SEQ ID NO: 1758) |
| 2198 | MFGSPSHFENL | 1267.5 | - | (SEQ ID NO: 1759) |
| 2199 | MFGSPSHYENL | 1283.5 | - | (SEQ ID NO: 1760) |
| 2200 | MFGSPSHWENL | 1306.6 | - | (SEQ ID NO: 1761) |
| 2202 | MFASPSMPENL | 1225.6 | - | (SEQ ID NO: 1762) |
| 2203 | MFASPSMFENL | 1275.6 | - | (SEQ ID NO: 1763) |
| 2204 | MFASPSMYENL | 1291.6 | - | (SEQ ID NO: 1764) |
| 2205 | MFASPSMWENL | 1314.7 | - | (SEQ ID NO: 1765) |
| 2207 | MFASPSFPENL | 1241.5 | - | (SEQ ID NO: 1766) |
| 2208 | MFASPSFFENL | 1291.5 | - | (SEQ ID NO: 1767) |
| 2209 | MFASPSFYENL | 1307.5 | - | (SEQ ID NO: 1768) |
| 2210 | MFASPSFWENL | 1330.6 | - | (SEQ ID NO: 1769) |
| 2212 | MFASPSYPENL | 1257.5 | - | (SEQ ID NO: 1770) |
| 2213 | MFASPSYFENL | 1307.5 | - | (SEQ ID NO: 1771) |
| 2214 | MFASPSYYENL | 1323.5 | - | (SEQ ID NO: 1772) |
| 2215 | MFASPSYWENL | 1346.6 | - | (SEQ ID NO: 1773) |
| 2217 | MFASPSDPENL | 1209.4 | - | (SEQ ID NO: 1774) |
| 2218 | MFASPSDFENL | 1259.4 | - | (SEQ ID NO: 1775) |
| 2219 | MFASPSDYENL | 1275.4 | - | (SEQ ID NO: 1776) |
| 2220 | MFASPSDWENL | 1298.5 | - | (SEQ ID NO: 1777) |
| 2222 | MFASPSEPENL | 1223.4 | - | (SEQ ID NO: 1778) |
| 2223 | MFASPSEFENL | 1273.4 | - | (SEQ ID NO: 1779) |
| 2224 | MFASPSEYENL | 1289.4 | - | (SEQ ID NO: 1780) |
| 2225 | MFASPSEWENL | 1312.5 | - | (SEQ ID NO: 1781) |
| 2227 | MFASPSNPENL | 1208.5 | - | (SEQ ID NO: 1782) |
| 2228 | MFASPSNFENL | 1258.5 | - | (SEQ ID NO: 1783) |
| 2229 | MFASPSNYENL | 1274.5 | - | (SEQ ID NO: 1784) |
| 2230 | MFASPSNWENL | 1297.6 | - | (SEQ ID NO: 1785) |
| 2232 | MFASPSQPENL | 1222.5 | - | (SEQ ID NO: 1786) |
| 2233 | MFASPSQFENL | 1272.5 | - | (SEQ ID NO: 1787) |
| 2234 | MFASPSQYENL | 1288.5 | - | (SEQ ID NO: 1788) |
| 2235 | MFASPSQWENL | 1311.6 | - | (SEQ ID NO: 1789) |
| 2237 | MFASPSHPENL | 1231.5 | - | (SEQ ID NO: 1790) |
| 2238 | MFASPSHFENL | 1281.5 | - | (SEQ ID NO: 1791) |
| 2239 | MFASPSHYENL | 1297.5 | - | (SEQ ID NO: 1792) |
| 2240 | MFASPSHWENL | 1320.6 | - | (SEQ ID NO: 1793) |
| 2242 | RYSLPPELSNM | 1308.6 | - | (SEQ ID NO: 1794) |
| 2243 | AYRSPSMPENL | 1266.5 | - | (SEQ ID NO: 1795) |
| 2244 | RYRSPSMPENL | 1351.6 | - | (SEQ ID NO: 1796) |
| 2245 | NYRSPSMPENL | 1309.6 | - | (SEQ ID NO: 1797) |
| 2246 | DYRSPSMPENL | 1310.5 | - | (SEQ ID NO: 1798) |
| 2247 | CYRSPSMPENL | 1298.6 | - | (SEQ ID NO: 1799) |
| 2248 | QYRSPSMPENL | 1323.6 | - | (SEQ ID NO: 1800) |
| 2249 | EYRSPSMPENL | 1324.5 | - | (SEQ ID NO: 1801) |
| 2250 | GYRSPSMPENL | 1252.5 | - | (SEQ ID NO: 1802) |
| 2251 | HYRSPSMPENL | 1332.6 | - | (SEQ ID NO: 1803) |
| 2252 | IYRSPSMPENL | 1308.6 | - | (SEQ ID NO: 1804) |
| 2253 | LYRSPSMPENL | 1308.6 | - | (SEQ ID NO: 1805) |
| 2254 | KYRSPSMPENL | 1323.6 | - | (SEQ ID NO: 1806) |
| 2255 | MYRSPSMPENL | 1326.7 | - | (SEQ ID NO: 1807) |
| 2256 | FYRSPSMPENL | 1342.6 | - | (SEQ ID NO: 1808) |
| 2257 | PYRSPSMPENL | 1292.6 | - | (SEQ ID NO: 1809) |
| 2258 | SYRSPSMPENL | 1283.3 | - | (SEQ ID NO: 1810) |
| 2259 | TYRSPSMPENL | 1296.5 | - | (SEQ ID NO: 1811) |
| 2260 | WYRSPSMPENL | 1381.7 | - | (SEQ ID NO: 1812) |
| 2261 | YYRSPSMPENL | 1358.6 | - | (SEQ ID NO: 1813) |
| 2262 | VYRSPSMPENL | 1294.6 | - | (SEQ ID NO: 1814) |
| 2263 | LARSPSMPENL | 1216.5 | - | (SEQ ID NO: 1815) |
| 2264 | LRRSPSMPENL | 1301.6 | - | (SEQ ID NO: 1816) |
| 2265 | LNRSPSMPENL | 1259.6 | - | (SEQ ID NO: 1817) |
| 2266 | LDRSPSMPENL | 1260.5 | - | (SEQ ID NO: 1818) |
| 2267 | LCRSPSMPENL | 1248.6 | - | (SEQ ID NO: 1819) |
| 2268 | LQRSPSMPENL | 1273.6 | - | (SEQ ID NO: 1820) |
| 2269 | LERSPSMPENL | 1274.5 | - | (SEQ ID NO: 1821) |
| 2270 | LGRSPSMPENL | 1202.5 | - | (SEQ ID NO: 1822) |
| 2271 | LHRSPSMPENL | 1282.6 | - | (SEQ ID NO: 1823) |
| 2272 | LIRSPSMPENL | 1258.6 | - | (SEQ ID NO: 1824) |
| 2273 | LLRSPSMPENL | 1258.6 | - | (SEQ ID NO: 1825) |
| 2274 | LKRSPSMPENL | 1273.6 | + | (SEQ ID NO: 1826) |
| 2275 | LMRSPSMPENL | 1276.7 | - | (SEQ ID NO: 1827) |
| 2276 | LFRSPSMPENL | 1292.6 | - | (SEQ ID NO: 1828) |
| 2277 | LPRSPSMPENL | 1242.6 | - | (SEQ ID NO: 1829) |
| 2278 | LSRSPSMPENL | 1233.3 | - | (SEQ ID NO: 1830) |

TABLE 1-continued

| | | | | |
|---|---|---|---|---|
| 2279 | LTRSPSMPENL | 1246.5 | – | (SEQ ID NO: 1831) |
| 2280 | LWRSPSMPENL | 1331.7 | – | (SEQ ID NO: 1832) |
| 2281 | LYRSPSMPENL | 1308.6 | – | (SEQ ID NO: 1833) |
| 2282 | LVRSPSMPENL | 1244.6 | – | (SEQ ID NO: 1834) |
| 2283 | LYASPSMPENL | 1223.5 | – | (SEQ ID NO: 1835) |
| 2284 | LYRSPSMPENL | 1308.6 | – | (SEQ ID NO: 1836) |
| 2285 | LYNSPSMPENL | 1266.6 | – | (SEQ ID NO: 1837) |
| 2286 | LYDSPSMPENL | 1267.5 | – | (SEQ ID NO: 1838) |
| 2287 | LYCSPSMPENL | 1255.6 | – | (SEQ ID NO: 1839) |
| 2288 | LYQSPSMPENL | 1280.6 | – | (SEQ ID NO: 1840) |
| 2289 | LYESPSMPENL | 1281.5 | – | (SEQ ID NO: 1841) |
| 2290 | LYGSPSMPENL | 1209.5 | – | (SEQ ID NO: 1842) |
| 2291 | LYHSPSMPENL | 1289.6 | – | (SEQ ID NO: 1843) |
| 2292 | LYISPSMPENL | 1265.6 | + | (SEQ ID NO: 1844) |
| 2293 | LYLSPSMPENL | 1265.6 | – | (SEQ ID NO: 1845) |
| 2294 | LYKSPSMPENL | 1280.6 | – | (SEQ ID NO: 1846) |
| 2295 | LYMSPSMPENL | 1283.7 | – | (SEQ ID NO: 1847) |
| 2296 | LYFSPSMPENL | 1299.6 | – | (SEQ ID NO: 1848) |
| 2297 | LYPSPSMPENL | 1249.6 | – | (SEQ ID NO: 1849) |
| 2298 | LYSSPSMPENL | 1240.3 | – | (SEQ ID NO: 1850) |
| 2299 | LYTSPSMPENL | 1253.5 | – | (SEQ ID NO: 1851) |
| 2300 | LYWSPSMPENL | 1338.7 | – | (SEQ ID NO: 1852) |
| 2301 | LYYSPSMPENL | 1315.6 | – | (SEQ ID NO: 1853) |
| 2302 | LYVSPSMPENL | 1251.6 | – | (SEQ ID NO: 1854) |
| 2303 | LYRSPSAPENL | 1248.4 | – | (SEQ ID NO: 1855) |
| 2304 | LYRSPSRPENL | 1333.5 | – | (SEQ ID NO: 1856) |
| 2305 | LYRSPSNPENL | 1291.5 | – | (SEQ ID NO: 1857) |
| 2306 | LYRSPSDPENL | 1292.4 | – | (SEQ ID NO: 1858) |
| 2307 | LYRSPSCPENL | 1280.5 | – | (SEQ ID NO: 1859) |
| 2308 | LYRSPSQPENL | 1305.5 | – | (SEQ ID NO: 1860) |
| 2309 | LYRSPSEPENL | 1306.4 | – | (SEQ ID NO: 1861) |
| 2310 | LYRSPSGPENL | 1234.4 | – | (SEQ ID NO: 1862) |
| 2311 | LYRSPSHPENL | 1314.5 | – | (SEQ ID NO: 1863) |
| 2312 | LYRSPSIPENL | 1290.5 | – | (SEQ ID NO: 1864) |
| 2313 | LYRSPSLPENL | 1290.5 | – | (SEQ ID NO: 1865) |
| 2314 | LYRSPSKPENL | 1305.5 | – | (SEQ ID NO: 1866) |
| 2315 | LYRSPSMPENL | 1308.6 | – | (SEQ ID NO: 1867) |
| 2316 | LYRSPSFPENL | 1324.5 | – | (SEQ ID NO: 1868) |
| 2317 | LYRSPSPPENL | 1274.5 | – | (SEQ ID NO: 1869) |
| 2318 | LYRSPSSPENL | 1265.2 | – | (SEQ ID NO: 1870) |
| 2319 | LYRSPSTPENL | 1278.4 | – | (SEQ ID NO: 1871) |
| 2320 | LYRSPSWPENL | 1363.6 | – | (SEQ ID NO: 1872) |
| 2321 | LYRSPSYPENL | 1340.5 | – | (SEQ ID NO: 1873) |
| 2322 | LYRSPSVPENL | 1276.5 | – | (SEQ ID NO: 1874) |
| 2323 | LYRSPSMAENL | 1282.5 | – | (SEQ ID NO: 1875) |
| 2324 | LYRSPSMRENL | 1367.6 | – | (SEQ ID NO: 1876) |
| 2325 | LYRSPSMNENL | 1325.6 | – | (SEQ ID NO: 1877) |
| 2326 | LYRSPSMDENL | 1326.5 | – | (SEQ ID NO: 1878) |
| 2327 | LYRSPSMCENL | 1314.6 | – | (SEQ ID NO: 1879) |
| 2328 | LYRSPSMQENL | 1339.6 | – | (SEQ ID NO: 1880) |
| 2329 | LYRSPSMEENL | 1340.5 | – | (SEQ ID NO: 1881) |
| 2330 | LYRSPSMGENL | 1268.5 | – | (SEQ ID NO: 1882) |
| 2331 | LYRSPSMHENL | 1348.6 | – | (SEQ ID NO: 1883) |
| 2332 | LYRSPSMIENL | 1324.6 | – | (SEQ ID NO: 1884) |
| 2333 | LYRSPSMLENL | 1324.6 | – | (SEQ ID NO: 1885) |
| 2334 | LYRSPSMKENL | 1339.6 | – | (SEQ ID NO: 1886) |
| 2335 | LYRSPSMMENL | 1342.7 | – | (SEQ ID NO: 1887) |
| 2336 | LYRSPSMFENL | 1358.6 | – | (SEQ ID NO: 1888) |
| 2337 | LYRSPSMPENL | 1308.6 | – | (SEQ ID NO: 1889) |
| 2338 | LYRSPSMSENL | 1299.3 | – | (SEQ ID NO: 1890) |
| 2339 | LYRSPSMTENL | 1312.5 | – | (SEQ ID NO: 1891) |
| 2340 | LYRSPSMWENL | 1397.7 | – | (SEQ ID NO: 1892) |
| 2341 | LYRSPSMYENL | 1374.6 | – | (SEQ ID NO: 1893) |
| 2342 | LYRSPSMVENL | 1310.6 | + | (SEQ ID NO: 1894) |

Example 3

G2 Abrogating Peptides of the Invention

The following example describes studies which identified exemplary G2 checkpoint-abrogating peptides of the invention. The following peptides of the invention were synthesized directly on membranes and tested in in vitro phosphorylation ("kination" assays, as described above.

TABLE 2

(SEQ ID NOS 1922-929)

| PEPTIDE | $X_1$ | $X_2$ | $X_3$ | $X_4$ | $X_5$ | $X_6$ | $X_7$ | $X_8$ | $X_9$ | $X_{10}$ | $X_{11}$ |
|---|---|---|---|---|---|---|---|---|---|---|---|
| AAA (SEQ ID NO 1296) | L | A | R | S | A | S | M | P | E | A | L |
| RANDOMII (SEQ ID NO 1) | R | Y | S | L | P | P | E | L | S | N | M |
| S216A (SEQ ID NO 1897) | L | Y | R | S | P | A | M | P | E | N | L |
| S216P (SEQ ID NO 2) | L | Y | R | S | P | S | M | P | E | N | L |
| YPN (SEQ ID NO 1895) | | Y | G | G | P | G | G | G | G | N | |
| YG7N (SEQ ID NO 1927) | | Y | G | G | G | G | G | G | G | N | |
| YG6N (SEQ ID NO 1928) | | Y | G | G | G | G | G | G | | N | |
| YG5N (SEQ ID NO 1929) | | Y | G | G | G | G | G | | | N | |

These peptides were tested in in vitro kination reactions. The oligopeptides were used as phosphorylation substrates; added kinases are involved in the cell cycle G2 checkpoint. Thus, a substance that inhibits the kination reaction can be a cell cycle 62 checkpoint abrogator. For the detection of the phosphorylation status of substrates in this screening method, isotope-labeled ATP and anti-phospho-peptides antibody can be used.

hChk1; hChk1 fusion proteins (MBP-peptide, GST-peptide), HuCds1/Chk2; HuCds1/Chk2 fusion proteins (MBP-peptide, GST-peptide); or, the cell extract from DNA damaged cells, can be used as the kinases in the screening assay.

The oligopeptides tested as substrates are Y $X_2$ $X_3$ P S $X_6$ $X_7$ $X_8$ N (SEQ ID NO: 1930) ($X_2$ through $X_9$, respectively; the first position ($X_1$) "Y" in this abbreviated nine residue motif corresponds to position $X_2$ in the eleven residue motif, described above) and variations thereof wherein amino acid residues at positions 2 ($X_2$) and position 3 ($X_3$) are Gly, Leu, Ser, or Arg; and the amino acid residue at position 6 through 8 are Gly, Leu, Ser, Met, Pro or Glu. Other tested oligopeptides sequence variations have amino acid residues at position 2 as Gly, Leu, Ser, or Arg; amino acid residues at position 3 as Gly, Leu or Ser; amino acid residues at position 6 as Gly, Met, Pro or Glu; amino acid residues at position 7 as Gly, Leu, or Pro; and, amino acid residues at position 8 as Gly, Met, Ser or Glu. In another variation the residue at position 2 was Arg; position 3 was Ser; position 6 was Met; position 7 was Pro; and, position 8 was Glu.

The cells with the deficient cell cycle G1 checkpoint (such as a human leukemia-derived cell line Jurkat) were treated with a DNA damaging treatment. As the DNA damaging treatment, the cells were treated with bleomycin or other anti-cancer drugs. These drugs were added to the cell culture medium. Alternatively, the cells were irradiated with gamma irradiation. Peptides were added to these cells and the amount of DNA was determined some 10 to 48 hours after the DNA damage. The harvested cells were re-suspended with the solution that includes propidium iodide, RNase and NP-40 and analyzed by flow cytometer. If the oligopeptide "candidate substance" induces cells not to accumulate DNA at G2/M by this analysis, the result is positive and the substance potentially abrogated G2/M checkpoint.

Other screening methods can be used to identify selective inhibitors of the G2 cell cycle checkpoint. For, the cells are simultaneously treated with an oligopeptide "candidate phosphorylation substrate" and an M phase checkpoint activator, such as colchicine or nocodazol. The DNA content of the cells are analyzed some 10 to 48 hours after the treatment as described above. The candidates that do not disturb the accumulation of the cells at G2/M will be the selected G2 checkpoint abrogators in this screening method.

In one embodiment, G2 checkpoint abrogators at positions 2 and 3 the have amino acid residues Gly, Leu, Ser or Arg, and at position 5 to 8 are amino acid residues Ser, Gly, Met, Pro or Glu.

In one embodiment of the invention the compositions are enhancers or augmenters of a DNA damaging anti-cancer treatment. By treating cancer cells simultaneously or sequentially with an anti-cancer treatment and a G2 checkpoint inhibiting composition of the invention, one can effectively kill the cancer cells. Since the most human cancer cells do not have an intact G1 checkpoint, the abrogation of the G2 checkpoint by a. G2 checkpoint inhibiting composition of the invention will effectively kill the cancer cells that are treated with a DNA damaging method. The compositions of the invention can be directly used as a drug (e.g., a pharmaceutical compositions) or these oligopeptides could be expressed recombinantly in vivo, e.g., from a virus vector or other expression vector, e.g., a plasmid, as an in vivo gene therapy.

Jurkat cells were cultured in 10% fetal calf serum with a medium (RPMI 1640) at 37° C./5% $CO_2$ with: bleomycin at 20 μg/ml; bleomycin at 20 μg/ml and the peptide "4aa" (amino acid sequence is GGSPSM (SEQ ID NO: 1931)); bleomycin at 20 μg/ml and the peptide AAA (Table 1); bleomycin at 20 μg/ml and the peptide YNP (Table 1). The amount of DNA was analyzed at 0, 6, 12, 24 hours after the addition of ten microgram of bleomycin with or without the oligopeptides "4aa," "YNP" and "AAA." The DNA quantity was analyzed by a flow cytometer (FACS) after the addition of a solution comprising propidium iodide, RNase and NP-40.

Figure 6:
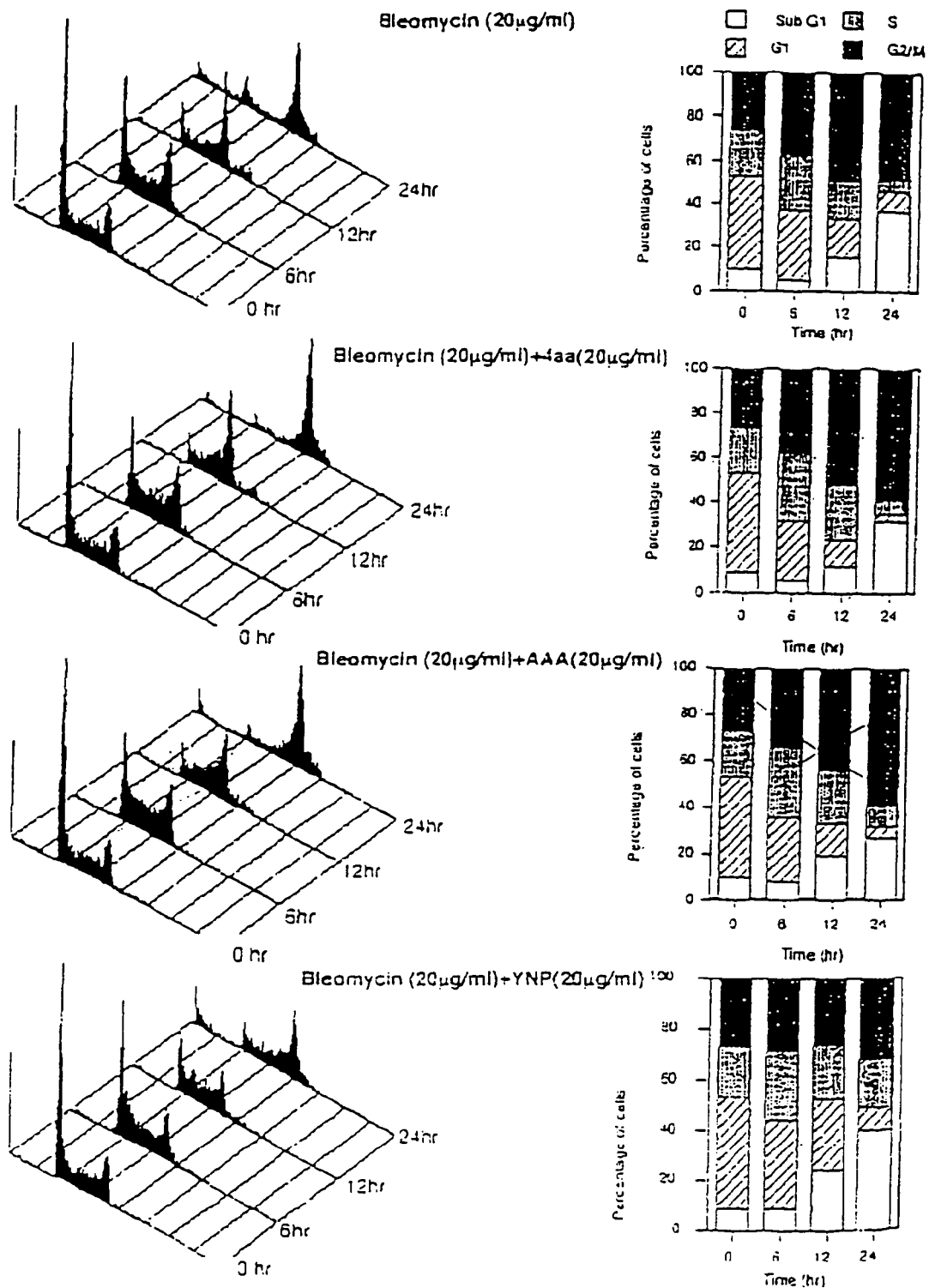
FIG. 6 shows the results of FACS analysis of the amount of DNA in cells to determine the number of cells in one of the four cell cycle phases after incubating these cells with bleomycin and exemplary peptides of the invention, as described in Example 3, below.

The results are shown in FIG. 6. The left panels are actual results of flow cytometer (FACS) analysis. The right panel indicates the population of cells in each of the cell cycle phases (sub G1, G1, S, and G2/M). The results indicated that YNP peptide abrogated the G2 checkpoint because the cells do not accumulate at G2/M phases.

In another experiment, an M phase checkpoint activator, colchicine, was used instead of bleomycin: colchicine at 2.5 μg/ml; colchicine at 2.5 μg/ml and the peptide "4aa"; colchicine at 2.5 μg/ml and the peptide AAA (Table 1); colchicine at 2.5 μg/ml and the peptide YNP (Table 1), and no treatment. The results are shown in FIG. 7. None of the above tested oligopeptides (Table 1), including, YPN, affected the accumulation of the colchicine-treated cells at the G2/M phase. These data indicated that YPN specifically abrogated the cell cycle at the G2 checkpoint.

Peptides which were tested and the results of these experiments are further summarized in FIGS. 8 and 9.

Example 4

Peptides of the Invention Sensitize Cancer Cells in in vivo Animal Model

The following example describes studies in an art-accepted animal model which demonstrated that exemplary peptides of the invention are effective agents for selectively sensitizing cancer cells to DNA damaging agents. In particular, nude mouse studies demonstrated the in vivo efficacy of the compositions and methods of the invention.

Human colon cancer cell line SW620 were injected subcutaneously into 3 week old Balb/c nude mouse ($1 \times 10^8$ cells per mouse). Some two weeks after the injection, the established subcutaneous tumors of diameter 2 to 4 mm were resected and transplanted to syngeneic mice. One week after the transplantation, the injection of cisplatin (CDDP) and peptides (TAT-control and TAT-S216, see Table 1) was started. The peptides were in the form of recombinant fusion proteins, with TAT being the protein transduction domain having the sequence YGRKKRRQRRR (SEQ ID NO: 1899).

Figure 10:
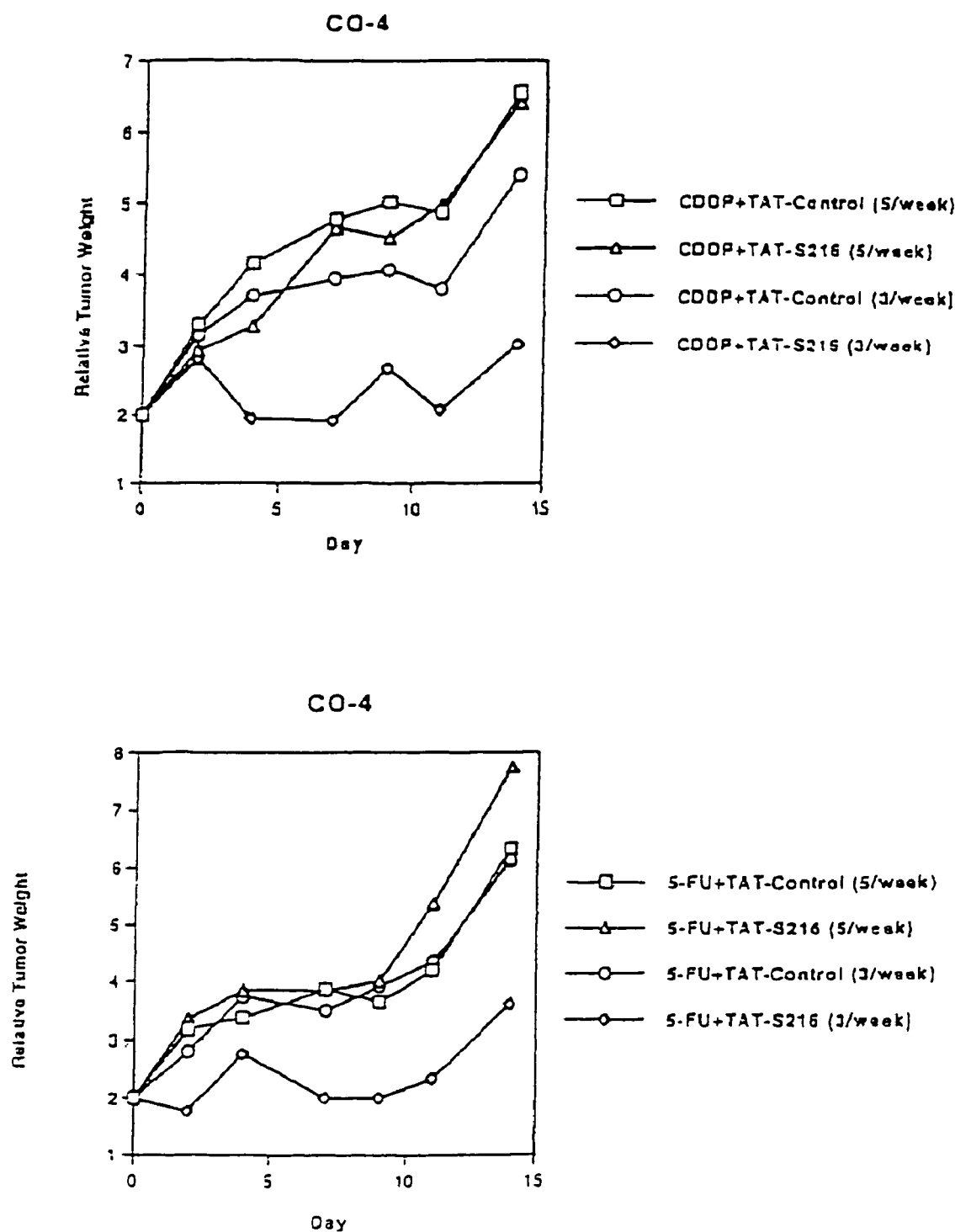
FIG. 10 shows the results of experiments demonstrating that a peptide of the invention (as a S216-containing fusion protein) administered to an animal in vivo effectively sensitized cancer cells to a DNA damaging agent.

Cisplatin (CDDP) at 6 mg/kg was injected once a week into peritoneum. Peptides (at 100 nM) were injected into tumor twice a week. Relative tumor weights were assessed at 3 and 5 weeks. The results are shown in FIG. 10, upper panel. Similar experiments were performed with 5-FU instead of cisplatin. The results are shown in FIG. 8, lower panel. As shown in FIG. 10, the S216-containing fusion protein effectively sensitized the cancer cells to a DNA damaging agent administered to the animal in vivo.

Figure 11:
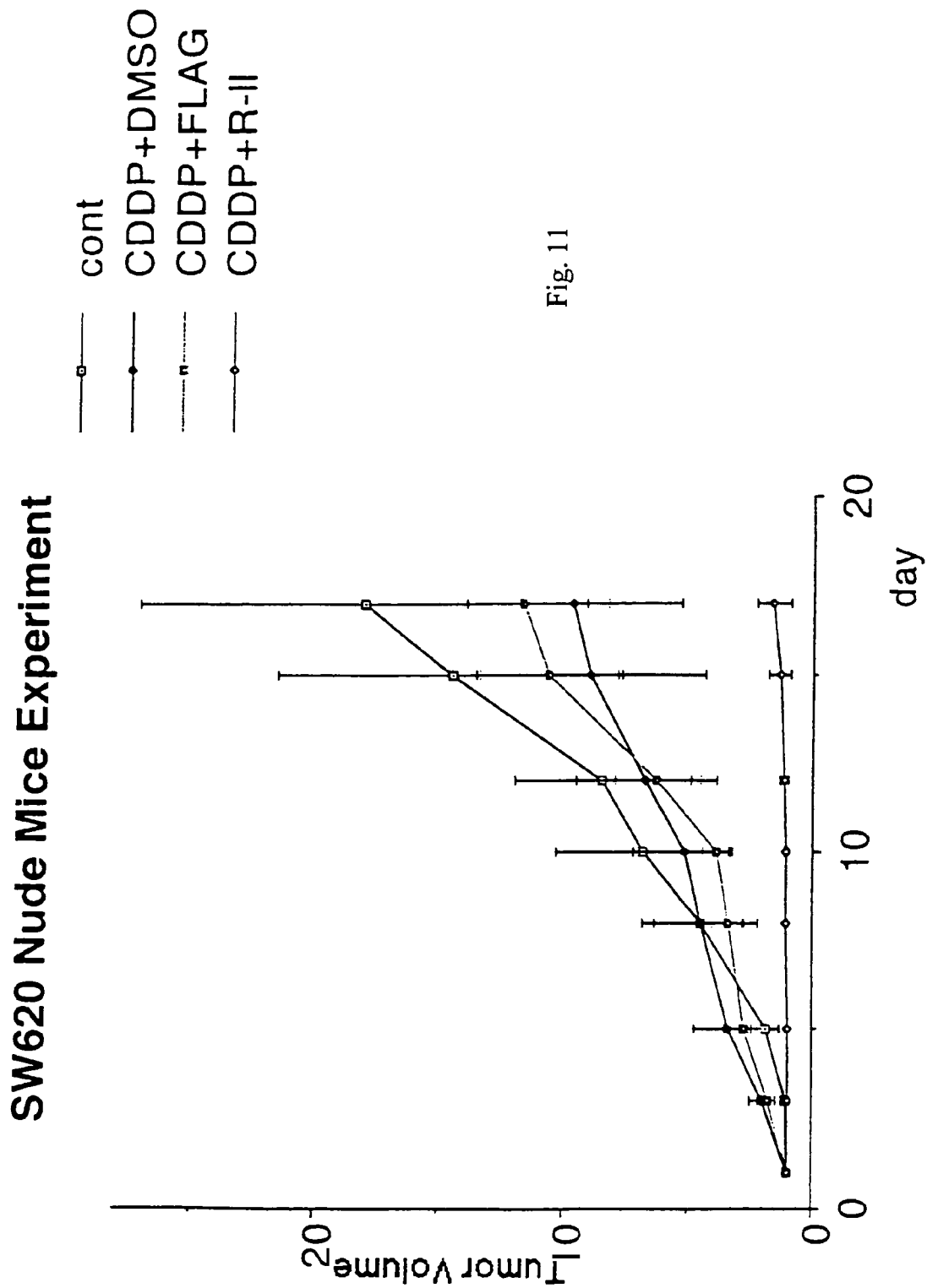
FIG. 11 shows the results of experiments demonstrating that a peptide of the invention (as a R-II-containing fusion protein) administered to an animal in vivo effectively sensitized cancer cells to a DNA damaging agent.

Similar experiments were performed with cisplatin (CDDP) and another exemplary peptide of the invention, "random II" or "R-II" (see Table 1). As with S216, RII peptide was in the form of a recombinant fusion protein with TAT. The relative volume of the transplanted subcutaneous tumor with or without cisplatin ("CDDP"), CDDP plus DMSO, CDDP plus TAT-FLAG or CDDP plus TAT-Random II peptide was determined. As shown in FIG. 11, the R-II containing fusion protein effectively sensitized the cancer cells to a DNA damaging agent administered to the animal in vivo.

A number of embodiments of the invention have been described. Nevertheless, it will be understood that various modifications may be made without departing from the spirit and scope of the invention. Accordingly, other embodiments are within the scope of the following claims.

SEQUENCE LISTING (1949 sequences)

SEQ ID NO: 1 - protein, 11 aa, Artificial Sequence
  Description of Artificial Sequence: Synthetic peptide
RYSLPPELSNM

SEQ ID NO: 2 - protein, 11 aa, Artificial Sequence
  Description of Artificial Sequence: Synthetic peptide
LYRSPSMPENL

SEQ ID NO: 3 - protein, 11 aa, Artificial Sequence
  Description of Artificial Sequence: Synthetic peptide
LYRSPSMFENL

SEQ ID NO: 4 - protein, 11 aa, Artificial Sequence
  Description of Artificial Sequence: Synthetic peptide
LYRSPSMYENL

SEQ ID NO: 5 - protein, 11 aa, Artificial Sequence
  Description of Artificial Sequence: Synthetic peptide
LYRSPSMWENL

SEQ ID NO: 6 - protein, 11 aa, Artificial Sequence
  Description of Artificial Sequence: Synthetic peptide
LYRSPSFPENL

SEQ ID NO: 7 - protein, 11 aa, Artificial Sequence
  Description of Artificial Sequence: Synthetic peptide
LYRSPSFFENL

SEQ ID NO: 8 - protein, 11 aa, Artificial Sequence
  Description of Artificial Sequence: Synthetic peptide
LYRSPSFYENL

SEQ ID NO: 9 - protein, 11 aa, Artificial Sequence
  Description of Artificial Sequence: Synthetic peptide
LYRSPSFWENL

SEQ ID NO: 10 - protein, 11 aa, Artificial Sequence
  Description of Artificial Sequence: Synthetic peptide
LYRSPSYPENL

SEQ ID NO: 11 - protein, 11 aa, Artificial Sequence
  Description of Artificial Sequence: Synthetic peptide
LYRSPSYFENL

SEQ ID NO: 12 - protein, 11 aa, Artificial Sequence
  Description of Artificial Sequence: Synthetic peptide
LYRSPSYYENL

SEQ ID NO: 13 - protein, 11 aa, Artificial Sequence
  Description of Artificial Sequence: Synthetic peptide
LYRSPSYWENL

SEQ ID NO: 14 - protein, 11 aa, Artificial Sequence
  Description of Artificial Sequence: Synthetic peptide
LYRSPSDPENL

SEQ ID NO: 15 - protein, 11 aa, Artificial Sequence
  Description of Artificial Sequence: Synthetic peptide
LYRSPSDFENL

SEQ ID NO: 16 - protein, 11 aa, Artificial Sequence
  Description of Artificial Sequence: Synthetic peptide
LYRSPSDYENL

SEQ ID NO: 17 - protein, 11 aa, Artificial Sequence
  Description of Artificial Sequence: Synthetic peptide
LYRSPSDWENL

SEQ ID NO: 18 - protein, 11 aa, Artificial Sequence
  Description of Artificial Sequence: Synthetic peptide
LYRSPSEPENL

SEQ ID NO: 19 - protein, 11 aa, Artificial Sequence
  Description of Artificial Sequence: Synthetic peptide
LYRSPSEFENL

SEQ ID NO: 20 - protein, 11 aa, Artificial Sequence
  Description of Artificial Sequence: Synthetic peptide
LYRSPSEYENL

SEQ ID NO: 21 - protein, 11 aa, Artificial Sequence
  Description of Artificial Sequence: Synthetic peptide
LYRSPSEWENL

SEQ ID NO: 22 - protein, 11 aa, Artificial Sequence
  Description of Artificial Sequence: Synthetic peptide
LYRSPSNPENL

SEQ ID NO: 23 - protein, 11 aa, Artificial Sequence
  Description of Artificial Sequence: Synthetic peptide
LYRSPSNFENL

SEQ ID NO: 24 - protein, 11 aa, Artificial Sequence
  Description of Artificial Sequence: Synthetic peptide
LYRSPSNYENL

SEQ ID NO: 25 - protein, 11 aa, Artificial Sequence
  Description of Artificial Sequence: Synthetic peptide
LYRSPSNWENL

SEQ ID NO: 26 - protein, 11 aa, Artificial Sequence
  Description of Artificial Sequence: Synthetic peptide
LYRSPSQPENL

SEQ ID NO: 27 - protein, 11 aa, Artificial Sequence
  Description of Artificial Sequence: Synthetic peptide
LYRSPSQFENL

SEQ ID NO: 28 - protein, 11 aa, Artificial Sequence
  Description of Artificial Sequence: Synthetic peptide
LYRSPSQYENL

SEQ ID NO: 29 - protein, 11 aa, Artificial Sequence
  Description of Artificial Sequence: Synthetic peptide
LYRSPSQWENL

SEQ ID NO: 30 - protein, 11 aa, Artificial Sequence
  Description of Artificial Sequence: Synthetic peptide
LYRSPSHPENL

SEQ ID NO: 31 - protein, 11 aa, Artificial Sequence
  Description of Artificial Sequence: Synthetic peptide
LYRSPSHFENL

SEQ ID NO: 32 - protein, 11 aa, Artificial Sequence
  Description of Artificial Sequence: Synthetic peptide
LYRSPSHYENL

SEQ ID NO: 33 - protein, 11 aa, Artificial Sequence
  Description of Artificial Sequence: Synthetic peptide
LYRSPSHWENL

SEQ ID NO: 34 - protein, 11 aa, Artificial Sequence
  Description of Artificial Sequence: Synthetic peptide
LYSSPSMPENL

SEQ ID NO: 35 - protein, 11 aa, Artificial Sequence
  Description of Artificial Sequence: Synthetic peptide
LYSSPSMFENL

SEQ ID NO: 36 - protein, 11 aa, Artificial Sequence
  Description of Artificial Sequence: Synthetic peptide
LYSSPSMYENL

SEQ ID NO: 37 - protein, 11 aa, Artificial Sequence
  Description of Artificial Sequence: Synthetic peptide
LYSSPSMWENL

SEQ ID NO: 38 - protein, 11 aa, Artificial Sequence
  Description of Artificial Sequence: Synthetic peptide
LYSSPSFPENL

SEQ ID NO: 39 - protein, 11 aa, Artificial Sequence
  Description of Artificial Sequence: Synthetic peptide
LYSSPSFFENL

SEQ ID NO: 40 - protein, 11 aa, Artificial Sequence
  Description of Artificial Sequence: Synthetic peptide
LYSSPSFYENL

SEQ ID NO: 41 - protein, 11 aa, Artificial Sequence
  Description of Artificial Sequence: Synthetic peptide
LYSSPSFWENL

SEQ ID NO: 42 - protein, 11 aa, Artificial Sequence
  Description of Artificial Sequence: Synthetic peptide
LYSSPSYPENL

SEQ ID NO: 43 - protein, 11 aa, Artificial Sequence
  Description of Artificial Sequence: Synthetic peptide
LYSSPSYFENL

SEQ ID NO: 44 - protein, 11 aa, Artificial Sequence
  Description of Artificial Sequence: Synthetic peptide
LYSSPSYYENL

SEQ ID NO: 45 - protein, 11 aa, Artificial Sequence
  Description of Artificial Sequence: Synthetic peptide
LYSSPSYWENL

SEQ ID NO: 46 - protein, 11 aa, Artificial Sequence
  Description of Artificial Sequence: Synthetic peptide
LYSSPSDPENL

SEQ ID NO: 47 - protein, 11 aa, Artificial Sequence
  Description of Artificial Sequence: Synthetic peptide
LYSSPSDFENL

SEQ ID NO: 48 - protein, 11 aa, Artificial Sequence
  Description of Artificial Sequence: Synthetic peptide
LYSSPSDYENL

SEQ ID NO: 49 - protein, 11 aa, Artificial Sequence
  Description of Artificial Sequence: Synthetic peptide
LYSSPSDWENL

SEQ ID NO: 50 - protein, 11 aa, Artificial Sequence
  Description of Artificial Sequence: Synthetic peptide
LYSSPSEPENL

SEQ ID NO: 51 - protein, 11 aa, Artificial Sequence
  Description of Artificial Sequence: Synthetic peptide
LYSSPSEFENL

SEQ ID NO: 52 - protein, 11 aa, Artificial Sequence
  Description of Artificial Sequence: Synthetic peptide
LYSSPSEYENL

SEQ ID NO: 53 - protein, 11 aa, Artificial Sequence
  Description of Artificial Sequence: Synthetic peptide
LYSSPSEWENL

SEQ ID NO: 54 - protein, 11 aa, Artificial Sequence
  Description of Artificial Sequence: Synthetic peptide
LYSSPSNPENL

SEQ ID NO: 55 - protein, 11 aa, Artificial Sequence
  Description of Artificial Sequence: Synthetic peptide
LYSSPSNFENL

SEQ ID NO: 56 - protein, 11 aa, Artificial Sequence
  Description of Artificial Sequence: Synthetic peptide
LYSSPSNYENL

SEQ ID NO: 57 - protein, 11 aa, Artificial Sequence
  Description of Artificial Sequence: Synthetic peptide
LYSSPSNWENL

SEQ ID NO: 58 - protein, 11 aa, Artificial Sequence
  Description of Artificial Sequence: Synthetic peptide
LYSSPSQPENL

SEQ ID NO: 59 - protein, 11 aa, Artificial Sequence
  Description of Artificial Sequence: Synthetic peptide
LYSSPSQFENL

SEQ ID NO: 60 - protein, 11 aa, Artificial Sequence
  Description of Artificial Sequence: Synthetic peptide
LYSSPSQYENL

SEQ ID NO: 61 - protein, 11 aa, Artificial Sequence
  Description of Artificial Sequence: Synthetic peptide
LYSSPSQWENL

SEQ ID NO: 62 - protein, 11 aa, Artificial Sequence
  Description of Artificial Sequence: Synthetic peptide
LYSSPSHPENL

SEQ ID NO: 63 - protein, 11 aa, Artificial Sequence
  Description of Artificial Sequence: Synthetic peptide
LYSSPSHFENL

SEQ ID NO: 64 - protein, 11 aa, Artificial Sequence
  Description of Artificial Sequence: Synthetic peptide
LYSSPSHYENL

SEQ ID NO: 65 - protein, 11 aa, Artificial Sequence
  Description of Artificial Sequence: Synthetic peptide
LYSSPSHWENL

SEQ ID NO: 66 - protein, 11 aa, Artificial Sequence
  Description of Artificial Sequence: Synthetic peptide
LYTSPSMPENL

SEQ ID NO: 67 - protein, 11 aa, Artificial Sequence
  Description of Artificial Sequence: Synthetic peptide
LYTSPSMFENL

SEQ ID NO: 68 - protein, 11 aa, Artificial Sequence
  Description of Artificial Sequence: Synthetic peptide
LYTSPSMYENL

SEQ ID NO: 69 - protein, 11 aa, Artificial Sequence
  Description of Artificial Sequence: Synthetic peptide
LYTSPSMWENL

SEQ ID NO: 70 - protein, 11 aa, Artificial Sequence
  Description of Artificial Sequence: Synthetic peptide
LYTSPSFPENL

SEQ ID NO: 71 - protein, 11 aa, Artificial Sequence
  Description of Artificial Sequence: Synthetic peptide
LYTSPSFFENL

SEQ ID NO: 72 - protein, 11 aa, Artificial Sequence
  Description of Artificial Sequence: Synthetic peptide
LYTSPSFYENL

SEQ ID NO: 73 - protein, 11 aa, Artificial Sequence
  Description of Artificial Sequence: Synthetic peptide
LYTSPSFWENL

SEQ ID NO: 74 - protein, 11 aa, Artificial Sequence
  Description of Artificial Sequence: Synthetic peptide
LYTSPSYPENL

SEQ ID NO: 75 - protein, 11 aa, Artificial Sequence
  Description of Artificial Sequence: Synthetic peptide
LYTSPSYFENL

SEQ ID NO: 76 - protein, 11 aa, Artificial Sequence
  Description of Artificial Sequence: Synthetic peptide
LYTSPSYYENL

SEQ ID NO: 77 - protein, 11 aa, Artificial Sequence
  Description of Artificial Sequence: Synthetic peptide
LYTSPSYWENL

SEQ ID NO: 78 - protein, 11 aa, Artificial Sequence
  Description of Artificial Sequence: Synthetic peptide
LYTSPSDPENL

SEQ ID NO: 79 - protein, 11 aa, Artificial Sequence
  Description of Artificial Sequence: Synthetic peptide
LYTSPSDFENL

SEQ ID NO: 80 - protein, 11 aa, Artificial Sequence
  Description of Artificial Sequence: Synthetic peptide
LYTSPSDYENL

SEQ ID NO: 81 - protein, 11 aa, Artificial Sequence
  Description of Artificial Sequence: Synthetic peptide
LYTSPSDWENL

SEQ ID NO: 82 - protein, 11 aa, Artificial Sequence
  Description of Artificial Sequence: Synthetic peptide
LYTSPSEPENL

SEQ ID NO: 83 - protein, 11 aa, Artificial Sequence
  Description of Artificial Sequence: Synthetic peptide
LYTSPSEFENL

SEQ ID NO: 84 - protein, 11 aa, Artificial Sequence
  Description of Artificial Sequence: Synthetic peptide
LYTSPSEYENL

SEQ ID NO: 85 - protein, 11 aa, Artificial Sequence
  Description of Artificial Sequence: Synthetic peptide
LYTSPSEWENL

SEQ ID NO: 86 - protein, 11 aa, Artificial Sequence
  Description of Artificial Sequence: Synthetic peptide
LYTSPSNPENL

SEQ ID NO: 87 - protein, 11 aa, Artificial Sequence
  Description of Artificial Sequence: Synthetic peptide
LYTSPSNFENL

SEQ ID NO: 88 - protein, 11 aa, Artificial Sequence
  Description of Artificial Sequence: Synthetic peptide
LYTSPSNYENL

SEQ ID NO: 89 - protein, 11 aa, Artificial Sequence
  Description of Artificial Sequence: Synthetic peptide
LYTSPSNWENL

SEQ ID NO: 90 - protein, 11 aa, Artificial Sequence
  Description of Artificial Sequence: Synthetic peptide
LYTSPSQPENL

SEQ ID NO: 91 - protein, 11 aa, Artificial Sequence
  Description of Artificial Sequence: Synthetic peptide
LYTSPSQFENL

SEQ ID NO: 92 - protein, 11 aa, Artificial Sequence
  Description of Artificial Sequence: Synthetic peptide
LYTSPSQYENL

SEQ ID NO: 93 - protein, 11 aa, Artificial Sequence
  Description of Artificial Sequence: Synthetic peptide
LYTSPSQWENL

SEQ ID NO: 94 - protein, 11 aa, Artificial Sequence
  Description of Artificial Sequence: Synthetic peptide
LYTSPSHPENL

SEQ ID NO: 95 - protein, 11 aa, Artificial Sequence
  Description of Artificial Sequence: Synthetic peptide
LYTSPSHFENL

SEQ ID NO: 96 - protein, 11 aa, Artificial Sequence
  Description of Artificial Sequence: Synthetic peptide
LYTSPSHYENL

SEQ ID NO: 97 - protein, 11 aa, Artificial Sequence
  Description of Artificial Sequence: Synthetic peptide
LYTSPSHWENL

SEQ ID NO: 98 - protein, 11 aa, Artificial Sequence
  Description of Artificial Sequence: Synthetic peptide
LYHSPSMPENL

SEQ ID NO: 99 - protein, 11 aa, Artificial Sequence
  Description of Artificial Sequence: Synthetic peptide
LYHSPSMFENL

SEQ ID NO: 100 - protein, 11 aa, Artificial Sequence
  Description of Artificial Sequence: Synthetic peptide
LYHSPSMYENL

SEQ ID NO: 101 - protein, 11 aa, Artificial Sequence
  Description of Artificial Sequence: Synthetic peptide
LYHSPSMWENL

SEQ ID NO: 102 - protein, 11 aa, Artificial Sequence
  Description of Artificial Sequence: Synthetic peptide
LYHSPSFPENL

SEQ ID NO: 103 - protein, 11 aa, Artificial Sequence
  Description of Artificial Sequence: Synthetic peptide
LYHSPSFFENL

SEQ ID NO: 104 - protein, 11 aa, Artificial Sequence
  Description of Artificial Sequence: Synthetic peptide
LYHSPSFYENL

SEQ ID NO: 105 - protein, 11 aa, Artificial Sequence
  Description of Artificial Sequence: Synthetic peptide
LYHSPSFWENL

SEQ ID NO: 106 - protein, 11 aa, Artificial Sequence
  Description of Artificial Sequence: Synthetic peptide
LYHSPSYPENL

SEQ ID NO: 107 - protein, 11 aa, Artificial Sequence
  Description of Artificial Sequence: Synthetic peptide
LYHSPSYFENL

SEQ ID NO: 108 - protein, 11 aa, Artificial Sequence
  Description of Artificial Sequence: Synthetic peptide
LYHSPSYYENL

SEQ ID NO: 109 - protein, 11 aa, Artificial Sequence
  Description of Artificial Sequence: Synthetic peptide
LYHSPSYWENL

SEQ ID NO: 110 - protein, 11 aa, Artificial Sequence
  Description of Artificial Sequence: Synthetic peptide
LYHSPSDPENL

SEQ ID NO: 111 - protein, 11 aa, Artificial Sequence
  Description of Artificial Sequence: Synthetic peptide
LYHSPSDFENL

SEQ ID NO: 112 - protein, 11 aa, Artificial Sequence
  Description of Artificial Sequence: Synthetic peptide
LYHSPSDYENL

SEQ ID NO: 113 - protein, 11 aa, Artificial Sequence
  Description of Artificial Sequence: Synthetic peptide
LYHSPSDWENL

SEQ ID NO: 114 - protein, 11 aa, Artificial Sequence
  Description of Artificial Sequence: Synthetic peptide
LYHSPSEPENL

SEQ ID NO: 115 - protein, 11 aa, Artificial Sequence
  Description of Artificial Sequence: Synthetic peptide
LYHSPSEFENL

SEQ ID NO: 116 - protein, 11 aa, Artificial Sequence
  Description of Artificial Sequence: Synthetic peptide
LYHSPSEYENL

SEQ ID NO: 117 - protein, 11 aa, Artificial Sequence
  Description of Artificial Sequence: Synthetic peptide
LYHSPSEWENL

SEQ ID NO: 118 - protein, 11 aa, Artificial Sequence
  Description of Artificial Sequence: Synthetic peptide
LYHSPSNPENL

SEQ ID NO: 119 - protein, 11 aa, Artificial Sequence
  Description of Artificial Sequence: Synthetic peptide
LYHSPSNFENL

SEQ ID NO: 120 - protein, 11 aa, Artificial Sequence
  Description of Artificial Sequence: Synthetic peptide
LYHSPSNYENL

SEQ ID NO: 121 - protein, 11 aa, Artificial Sequence
  Description of Artificial Sequence: Synthetic peptide
LYHSPSNWENL

SEQ ID NO: 122 - protein, 11 aa, Artificial Sequence
  Description of Artificial Sequence: Synthetic peptide
LYHSPSQPENL

SEQ ID NO: 123 - protein, 11 aa, Artificial Sequence
  Description of Artificial Sequence: Synthetic peptide
LYHSPSQFENL

SEQ ID NO: 124 - protein, 11 aa, Artificial Sequence
  Description of Artificial Sequence: Synthetic peptide
LYHSPSQYENL

SEQ ID NO: 125 - protein, 11 aa, Artificial Sequence
  Description of Artificial Sequence: Synthetic peptide
LYHSPSQWENL

SEQ ID NO: 126 - protein, 11 aa, Artificial Sequence
  Description of Artificial Sequence: Synthetic peptide
LYHSPSHPENL

SEQ ID NO: 127 - protein, 11 aa, Artificial Sequence
  Description of Artificial Sequence: Synthetic peptide
LYHSPSHFENL

SEQ ID NO: 128 - protein, 11 aa, Artificial Sequence
  Description of Artificial Sequence: Synthetic peptide
LYHSPSHYENL

SEQ ID NO: 129 - protein, 11 aa, Artificial Sequence
  Description of Artificial Sequence: Synthetic peptide
LYHSPSHWENL

SEQ ID NO: 130 - protein, 11 aa, Artificial Sequence
  Description of Artificial Sequence: Synthetic peptide
LYNSPSMPENL

SEQ ID NO: 131 - protein, 11 aa, Artificial Sequence
  Description of Artificial Sequence: Synthetic peptide
LYNSPSMFENL

SEQ ID NO: 132 - protein, 11 aa, Artificial Sequence
  Description of Artificial Sequence: Synthetic peptide
LYNSPSMYENL

SEQ ID NO: 133 - protein, 11 aa, Artificial Sequence
  Description of Artificial Sequence: Synthetic peptide
LYNSPSMWENL

SEQ ID NO: 134 - protein, 11 aa, Artificial Sequence
  Description of Artificial Sequence: Synthetic peptide
LYNSPSFPENL

SEQ ID NO: 135 - protein, 11 aa, Artificial Sequence
  Description of Artificial Sequence: Synthetic peptide
LYNSPSFFENL

SEQ ID NO: 136 - protein, 11 aa, Artificial Sequence
  Description of Artificial Sequence: Synthetic peptide
LYNSPSFYENL

SEQ ID NO: 137 - protein, 11 aa, Artificial Sequence
  Description of Artificial Sequence: Synthetic peptide
LYNSPSFWENL

SEQ ID NO: 138 - protein, 11 aa, Artificial Sequence
  Description of Artificial Sequence: Synthetic peptide
LYNSPSYPENL

SEQ ID NO: 139 - protein, 11 aa, Artificial Sequence
  Description of Artificial Sequence: Synthetic peptide
LYNSPSYFENL

SEQ ID NO: 140 - protein, 11 aa, Artificial Sequence
  Description of Artificial Sequence: Synthetic peptide
LYNSPSYYENL

SEQ ID NO: 141 - protein, 11 aa, Artificial Sequence
  Description of Artificial Sequence: Synthetic peptide
LYNSPSYWENL

SEQ ID NO: 142 - protein, 11 aa, Artificial Sequence
  Description of Artificial Sequence: Synthetic peptide
LYNSPSDPENL

SEQ ID NO: 143 - protein, 11 aa, Artificial Sequence
  Description of Artificial Sequence: Synthetic peptide
LYNSPSDFENL

SEQ ID NO: 144 - protein, 11 aa, Artificial Sequence
  Description of Artificial Sequence: Synthetic peptide
LYNSPSDYENL

SEQ ID NO: 145 - protein, 11 aa, Artificial Sequence
  Description of Artificial Sequence: Synthetic peptide
LYNSPSDWENL

SEQ ID NO: 146 - protein, 11 aa, Artificial Sequence
  Description of Artificial Sequence: Synthetic peptide
LYNSPSEPENL

SEQ ID NO: 147 - protein, 11 aa, Artificial Sequence
  Description of Artificial Sequence: Synthetic peptide
LYNSPSEFENL

SEQ ID NO: 148 - protein, 11 aa, Artificial Sequence
  Description of Artificial Sequence: Synthetic peptide
LYNSPSEYENL

SEQ ID NO: 149 - protein, 11 aa, Artificial Sequence
  Description of Artificial Sequence: Synthetic peptide
LYNSPSEWENL

SEQ ID NO: 150 - protein, 11 aa, Artificial Sequence
  Description of Artificial Sequence: Synthetic peptide
LYNSPSNPENL

SEQ ID NO: 151 - protein, 11 aa, Artificial Sequence
  Description of Artificial Sequence: Synthetic peptide
LYNSPSNFENL

SEQ ID NO: 152 - protein, 11 aa, Artificial Sequence
  Description of Artificial Sequence: Synthetic peptide
LYNSPSNYENL

SEQ ID NO: 153 - protein, 11 aa, Artificial Sequence
  Description of Artificial Sequence: Synthetic peptide
LYNSPSNWENL

SEQ ID NO: 154 - protein, 11 aa, Artificial Sequence
  Description of Artificial Sequence: Synthetic peptide
LYNSPSQPENL

SEQ ID NO: 155 - protein, 11 aa, Artificial Sequence
  Description of Artificial Sequence: Synthetic peptide
LYNSPSQFENL

SEQ ID NO: 156 - protein, 11 aa, Artificial Sequence
  Description of Artificial Sequence: Synthetic peptide
LYNSPSQYENL

SEQ ID NO: 157 - protein, 11 aa, Artificial Sequence
  Description of Artificial Sequence: Synthetic peptide
LYNSPSQWENL

SEQ ID NO: 158 - protein, 11 aa, Artificial Sequence
  Description of Artificial Sequence: Synthetic peptide
LYNSPSHPENL

SEQ ID NO: 159 - protein, 11 aa, Artificial Sequence
  Description of Artificial Sequence: Synthetic peptide
LYNSPSHFENL

SEQ ID NO: 160 - protein, 11 aa, Artificial Sequence
  Description of Artificial Sequence: Synthetic peptide
LYNSPSHYENL

SEQ ID NO: 161 - protein, 11 aa, Artificial Sequence
  Description of Artificial Sequence: Synthetic peptide
LYNSPSHWENL

SEQ ID NO: 162 - protein, 11 aa, Artificial Sequence
  Description of Artificial Sequence: Synthetic peptide
LYGSPSMPENL

SEQ ID NO: 163 - protein, 11 aa, Artificial Sequence
  Description of Artificial Sequence: Synthetic peptide
LYGSPSMFENL

SEQ ID NO: 164 - protein, 11 aa, Artificial Sequence
  Description of Artificial Sequence: Synthetic peptide
LYGSPSMYENL

SEQ ID NO: 165 - protein, 11 aa, Artificial Sequence
  Description of Artificial Sequence: Synthetic peptide
LYGSPSMWENL

SEQ ID NO: 166 - protein, 11 aa, Artificial Sequence
  Description of Artificial Sequence: Synthetic peptide
LYGSPSFPENL

SEQ ID NO: 167 - protein, 11 aa, Artificial Sequence
  Description of Artificial Sequence: Synthetic peptide
LYGSPSFFENL

SEQ ID NO: 168 - protein, 11 aa, Artificial Sequence
  Description of Artificial Sequence: Synthetic peptide
LYGSPSFYENL

SEQ ID NO: 169 - protein, 11 aa, Artificial Sequence
  Description of Artificial Sequence: Synthetic peptide
LYGSPSFWENL

SEQ ID NO: 170 - protein, 11 aa, Artificial Sequence
  Description of Artificial Sequence: Synthetic peptide
LYGSPSYPENL

SEQ ID NO: 171 - protein, 11 aa, Artificial Sequence
  Description of Artificial Sequence: Synthetic peptide
LYGSPSYFENL

SEQ ID NO: 172 - protein, 11 aa, Artificial Sequence
  Description of Artificial Sequence: Synthetic peptide
LYGSPSYYENL

SEQ ID NO: 173 - protein, 11 aa, Artificial Sequence
  Description of Artificial Sequence: Synthetic peptide
LYGSPSYWENL

SEQ ID NO: 174 - protein, 11 aa, Artificial Sequence
  Description of Artificial Sequence: Synthetic peptide
LYGSPSDPENL

SEQ ID NO: 175 - protein, 11 aa, Artificial Sequence
  Description of Artificial Sequence: Synthetic peptide
LYGSPSDFENL

SEQ ID NO: 176 - protein, 11 aa, Artificial Sequence
  Description of Artificial Sequence: Synthetic peptide
LYGSPSDYENL

SEQ ID NO: 177 - protein, 11 aa, Artificial Sequence
  Description of Artificial Sequence: Synthetic peptide
LYGSPSDWENL

SEQ ID NO: 178 - protein, 11 aa, Artificial Sequence
  Description of Artificial Sequence: Synthetic peptide
LYGSPSEPENL

SEQ ID NO: 179 - protein, 11 aa, Artificial Sequence
  Description of Artificial Sequence: Synthetic peptide
LYGSPSEFENL

SEQ ID NO: 180 - protein, 11 aa, Artificial Sequence
  Description of Artificial Sequence: Synthetic peptide
LYGSPSEYENL

SEQ ID NO: 181 - protein, 11 aa, Artificial Sequence
  Description of Artificial Sequence: Synthetic peptide
LYGSPSEWENL

SEQ ID NO: 182 - protein, 11 aa, Artificial Sequence
  Description of Artificial Sequence: Synthetic peptide
LYGSPSNPENL

SEQ ID NO: 183 - protein, 11 aa, Artificial Sequence
  Description of Artificial Sequence: Synthetic peptide
LYGSPSNFENL

SEQ ID NO: 184 - protein, 11 aa, Artificial Sequence
  Description of Artificial Sequence: Synthetic peptide
LYGSPSNYENL

SEQ ID NO: 185 - protein, 11 aa, Artificial Sequence
  Description of Artificial Sequence: Synthetic peptide
LYGSPSNWENL

SEQ ID NO: 186 - protein, 11 aa, Artificial Sequence
  Description of Artificial Sequence: Synthetic peptide
LYGSPSQPENL

SEQ ID NO: 187 - protein, 11 aa, Artificial Sequence
  Description of Artificial Sequence: Synthetic peptide
LYGSPSQFENL

SEQ ID NO: 188 - protein, 11 aa, Artificial Sequence
  Description of Artificial Sequence: Synthetic peptide
LYGSPSQYENL

SEQ ID NO: 189 - protein, 11 aa, Artificial Sequence
  Description of Artificial Sequence: Synthetic peptide
LYGSPSQWENL

SEQ ID NO: 190 - protein, 11 aa, Artificial Sequence
  Description of Artificial Sequence: Synthetic peptide
LYGSPSHPENL

SEQ ID NO: 191 - protein, 11 aa, Artificial Sequence
  Description of Artificial Sequence: Synthetic peptide
LYGSPSHFENL

SEQ ID NO: 192 - protein, 11 aa, Artificial Sequence
  Description of Artificial Sequence: Synthetic peptide
LYGSPSHYENL

SEQ ID NO: 193 - protein, 11 aa, Artificial Sequence
  Description of Artificial Sequence: Synthetic peptide
LYGSPSHWENL

SEQ ID NO: 194 - protein, 11 aa, Artificial Sequence
  Description of Artificial Sequence: Synthetic peptide
LYASPSMPENL

SEQ ID NO: 195 - protein, 11 aa, Artificial Sequence
  Description of Artificial Sequence: Synthetic peptide
LYASPSMFENL

SEQ ID NO: 196 - protein, 11 aa, Artificial Sequence
  Description of Artificial Sequence: Synthetic peptide
LYASPSMYENL

SEQ ID NO: 197 - protein, 11 aa, Artificial Sequence
  Description of Artificial Sequence: Synthetic peptide
LYASPSMWENL

SEQ ID NO: 198 - protein, 11 aa, Artificial Sequence
  Description of Artificial Sequence: Synthetic peptide
LYASPSFPENL

SEQ ID NO: 199 - protein, 11 aa, Artificial Sequence
  Description of Artificial Sequence: Synthetic peptide
LYASPSFFENL

SEQ ID NO: 200 - protein, 11 aa, Artificial Sequence
  Description of Artificial Sequence: Synthetic peptide
LYASPSFYENL

SEQ ID NO: 201 - protein, 11 aa, Artificial Sequence
  Description of Artificial Sequence: Synthetic peptide
LYASPSFWENL

SEQ ID NO: 202 - protein, 11 aa, Artificial Sequence
  Description of Artificial Sequence: Synthetic peptide
LYASPSYPENL

SEQ ID NO: 203 - protein, 11 aa, Artificial Sequence
  Description of Artificial Sequence: Synthetic peptide
LYASPSYFENL

SEQ ID NO: 204 - protein, 11 aa, Artificial Sequence
  Description of Artificial Sequence: Synthetic peptide
LYASPSYYENL

SEQ ID NO: 205 - protein, 11 aa, Artificial Sequence
  Description of Artificial Sequence: Synthetic peptide
LYASPSYWENL

SEQ ID NO: 206 - protein, 11 aa, Artificial Sequence
  Description of Artificial Sequence: Synthetic peptide
LYASPSDPENL

SEQ ID NO: 207 - protein, 11 aa, Artificial Sequence
  Description of Artificial Sequence: Synthetic peptide
LYASPSDFENL

SEQ ID NO: 208 - protein, 11 aa, Artificial Sequence
  Description of Artificial Sequence: Synthetic peptide
LYASPSDYENL

SEQ ID NO: 209 - protein, 11 aa, Artificial Sequence
  Description of Artificial Sequence: Synthetic peptide
LYASPSDWENL

SEQ ID NO: 210 - protein, 11 aa, Artificial Sequence
  Description of Artificial Sequence: Synthetic peptide
LYASPSEPENL

SEQ ID NO: 211 - protein, 11 aa, Artificial Sequence
  Description of Artificial Sequence: Synthetic peptide
LYASPSEFENL

SEQ ID NO: 212 - protein, 11 aa, Artificial Sequence
  Description of Artificial Sequence: Synthetic peptide
LYASPSEYENL

SEQ ID NO: 213 - protein, 11 aa, Artificial Sequence
  Description of Artificial Sequence: Synthetic peptide
LYASPSEWENL

SEQ ID NO: 214 - protein, 11 aa, Artificial Sequence
  Description of Artificial Sequence: Synthetic peptide
LYASPSNPENL

SEQ ID NO: 215 - protein, 11 aa, Artificial Sequence
  Description of Artificial Sequence: Synthetic peptide
LYASPSNFENL

SEQ ID NO: 216 - protein, 11 aa, Artificial Sequence
  Description of Artificial Sequence: Synthetic peptide
LYASPSNYENL

SEQ ID NO: 217 - protein, 11 aa, Artificial Sequence
  Description of Artificial Sequence: Synthetic peptide
LYASPSNWENL

SEQ ID NO: 218 - protein, 11 aa, Artificial Sequence
  Description of Artificial Sequence: Synthetic peptide
LYASPSQPENL

SEQ ID NO: 219 - protein, 11 aa, Artificial Sequence
  Description of Artificial Sequence: Synthetic peptide
LYASPSQFENL

SEQ ID NO: 220 - protein, 11 aa, Artificial Sequence
  Description of Artificial Sequence: Synthetic peptide
LYASPSQYENL

SEQ ID NO: 221 - protein, 11 aa, Artificial Sequence
  Description of Artificial Sequence: Synthetic peptide
LYASPSQWENL

SEQ ID NO: 222 - protein, 11 aa, Artificial Sequence
  Description of Artificial Sequence: Synthetic peptide
LYASPSHPENL

SEQ ID NO: 223 - protein, 11 aa, Artificial Sequence
  Description of Artificial Sequence: Synthetic peptide
LYASPSHFENL

SEQ ID NO: 224 - protein, 11 aa, Artificial Sequence
  Description of Artificial Sequence: Synthetic peptide
LYASPSHYENL

SEQ ID NO: 225 - protein, 11 aa, Artificial Sequence
  Description of Artificial Sequence: Synthetic peptide
LYASPSHWENL

SEQ ID NO: 226 - protein, 11 aa, Artificial Sequence
  Description of Artificial Sequence: Synthetic peptide
LFRSPSMPENL

SEQ ID NO: 227 - protein, 11 aa, Artificial Sequence
  Description of Artificial Sequence: Synthetic peptide
LFRSPSMFENL

SEQ ID NO: 228 - protein, 11 aa, Artificial Sequence
  Description of Artificial Sequence: Synthetic peptide
LFRSPSMYENL

SEQ ID NO: 229 - protein, 11 aa, Artificial Sequence
  Description of Artificial Sequence: Synthetic peptide
LFRSPSMWENL

SEQ ID NO: 230 - protein, 11 aa, Artificial Sequence
  Description of Artificial Sequence: Synthetic peptide
LFRSPSFPENL

SEQ ID NO: 231 - protein, 11 aa, Artificial Sequence
  Description of Artificial Sequence: Synthetic peptide
LFRSPSFFENL

SEQ ID NO: 232 - protein, 11 aa, Artificial Sequence
  Description of Artificial Sequence: Synthetic peptide
LFRSPSFYENL

SEQ ID NO: 233 - protein, 11 aa, Artificial Sequence
  Description of Artificial Sequence: Synthetic peptide
LFRSPSFWENL

SEQ ID NO: 234 - protein, 11 aa, Artificial Sequence
  Description of Artificial Sequence: Synthetic peptide
LFRSPSYPENL

SEQ ID NO: 235 - protein, 11 aa, Artificial Sequence
  Description of Artificial Sequence: Synthetic peptide
LFRSPSYFENL

SEQ ID NO: 236 - protein, 11 aa, Artificial Sequence
  Description of Artificial Sequence: Synthetic peptide
LFRSPSYYENL

SEQ ID NO: 237 - protein, 11 aa, Artificial Sequence
  Description of Artificial Sequence: Synthetic peptide
LFRSPSYWENL

SEQ ID NO: 238 - protein, 11 aa, Artificial Sequence
  Description of Artificial Sequence: Synthetic peptide
LFRSPSDPENL

SEQ ID NO: 239 - protein, 11 aa, Artificial Sequence
  Description of Artificial Sequence: Synthetic peptide
LFRSPSDFENL

SEQ ID NO: 240 - protein, 11 aa, Artificial Sequence
  Description of Artificial Sequence: Synthetic peptide
LFRSPSDYENL

SEQ ID NO: 241 - protein, 11 aa, Artificial Sequence
  Description of Artificial Sequence: Synthetic peptide
LFRSPSDWENL

SEQ ID NO: 242 - protein, 11 aa, Artificial Sequence
  Description of Artificial Sequence: Synthetic peptide
LFRSPSEPENL

SEQ ID NO: 243 - protein, 11 aa, Artificial Sequence
  Description of Artificial Sequence: Synthetic peptide
LFRSPSEFENL

SEQ ID NO: 244 - protein, 11 aa, Artificial Sequence
  Description of Artificial Sequence: Synthetic peptide
LFRSPSEYENL

SEQ ID NO: 245 - protein, 11 aa, Artificial Sequence
  Description of Artificial Sequence: Synthetic peptide
LFRSPSEWENL

SEQ ID NO: 246 - protein, 11 aa, Artificial Sequence
  Description of Artificial Sequence: Synthetic peptide
LFRSPSNPENL

SEQ ID NO: 247 - protein, 11 aa, Artificial Sequence
  Description of Artificial Sequence: Synthetic peptide
LFRSPSNFENL

SEQ ID NO: 248 - protein, 11 aa, Artificial Sequence
  Description of Artificial Sequence: Synthetic peptide
LFRSPSNYENL

SEQ ID NO: 249 - protein, 11 aa, Artificial Sequence
  Description of Artificial Sequence: Synthetic peptide
LFRSPSNWENL

SEQ ID NO: 250 - protein, 11 aa, Artificial Sequence
  Description of Artificial Sequence: Synthetic peptide
LFRSPSQPENL

SEQ ID NO: 251 - protein, 11 aa, Artificial Sequence
  Description of Artificial Sequence: Synthetic peptide
LFRSPSQFENL

SEQ ID NO: 252 - protein, 11 aa, Artificial Sequence
  Description of Artificial Sequence: Synthetic peptide
LFRSPSQYENL

SEQ ID NO: 253 - protein, 11 aa, Artificial Sequence
  Description of Artificial Sequence: Synthetic peptide
LFRSPSQWENL

SEQ ID NO: 254 - protein, 11 aa, Artificial Sequence
  Description of Artificial Sequence: Synthetic peptide
LFRSPSHPENL

SEQ ID NO: 255 - protein, 11 aa, Artificial Sequence
  Description of Artificial Sequence: Synthetic peptide
LFRSPSHFENL

SEQ ID NO: 256 - protein, 11 aa, Artificial Sequence
  Description of Artificial Sequence: Synthetic peptide
LFRSPSHYENL

SEQ ID NO: 257 - protein, 11 aa, Artificial Sequence
  Description of Artificial Sequence: Synthetic peptide
LFRSPSHWENL

SEQ ID NO: 258 - protein, 11 aa, Artificial Sequence
  Description of Artificial Sequence: Synthetic peptide
LFSSPSMPENL

SEQ ID NO: 259 - protein, 11 aa, Artificial Sequence
  Description of Artificial Sequence: Synthetic peptide
LFSSPSMFENL

SEQ ID NO: 260 - protein, 11 aa, Artificial Sequence
  Description of Artificial Sequence: Synthetic peptide
LFSSPSMYENL

SEQ ID NO: 261 - protein, 11 aa, Artificial Sequence
  Description of Artificial Sequence: Synthetic peptide
LFSSPSMWENL

SEQ ID NO: 262 - protein, 11 aa, Artificial Sequence
  Description of Artificial Sequence: Synthetic peptide
LFSSPSFPENL

SEQ ID NO: 263 - protein, 11 aa, Artificial Sequence
  Description of Artificial Sequence: Synthetic peptide
LFSSPSFFENL

SEQ ID NO: 264 - protein, 11 aa, Artificial Sequence
  Description of Artificial Sequence: Synthetic peptide
LFSSPSFYENL

SEQ ID NO: 265 - protein, 11 aa, Artificial Sequence
  Description of Artificial Sequence: Synthetic peptide
LFSSPSFWENL

SEQ ID NO: 266 - protein, 11 aa, Artificial Sequence
  Description of Artificial Sequence: Synthetic peptide
LFSSPSYPENL

SEQ ID NO: 267 - protein, 11 aa, Artificial Sequence
  Description of Artificial Sequence: Synthetic peptide
LFSSPSYFENL

SEQ ID NO: 268 - protein, 11 aa, Artificial Sequence
  Description of Artificial Sequence: Synthetic peptide
LFSSPSYYENL

SEQ ID NO: 269 - protein, 11 aa, Artificial Sequence
  Description of Artificial Sequence: Synthetic peptide
LFSSPSYWENL

SEQ ID NO: 270 - protein, 11 aa, Artificial Sequence
  Description of Artificial Sequence: Synthetic peptide
LFSSPSDPENL

SEQ ID NO: 271 - protein, 11 aa, Artificial Sequence
  Description of Artificial Sequence: Synthetic peptide
LFSSPSDFENL

SEQ ID NO: 272 - protein, 11 aa, Artificial Sequence
  Description of Artificial Sequence: Synthetic peptide
LFSSPSDYENL

SEQ ID NO: 273 - protein, 11 aa, Artificial Sequence
  Description of Artificial Sequence: Synthetic peptide
LFSSPSDWENL

SEQ ID NO: 274 - protein, 11 aa, Artificial Sequence
  Description of Artificial Sequence: Synthetic peptide
LFSSPSEPENL

SEQ ID NO: 275 - protein, 11 aa, Artificial Sequence
  Description of Artificial Sequence: Synthetic peptide
LFSSPSEFENL

SEQ ID NO: 276 - protein, 11 aa, Artificial Sequence
  Description of Artificial Sequence: Synthetic peptide
LFSSPSEYENL

SEQ ID NO: 277 - protein, 11 aa, Artificial Sequence
  Description of Artificial Sequence: Synthetic peptide
LFSSPSEWENL

SEQ ID NO: 278 - protein, 11 aa, Artificial Sequence
  Description of Artificial Sequence: Synthetic peptide
LFSSPSNPENL

SEQ ID NO: 279 - protein, 11 aa, Artificial Sequence
  Description of Artificial Sequence: Synthetic peptide
LFSSPSNFENL

SEQ ID NO: 280 - protein, 11 aa, Artificial Sequence
  Description of Artificial Sequence: Synthetic peptide
LFSSPSNYENL

SEQ ID NO: 281 - protein, 11 aa, Artificial Sequence
  Description of Artificial Sequence: Synthetic peptide
LFSSPSNWENL

SEQ ID NO: 282 - protein, 11 aa, Artificial Sequence
  Description of Artificial Sequence: Synthetic peptide
LFSSPSQPENL

SEQ ID NO: 283 - protein, 11 aa, Artificial Sequence
  Description of Artificial Sequence: Synthetic peptide
LFSSPSQFENL

SEQ ID NO: 284 - protein, 11 aa, Artificial Sequence
  Description of Artificial Sequence: Synthetic peptide
LFSSPSQYENL

SEQ ID NO: 285 - protein, 11 aa, Artificial Sequence
  Description of Artificial Sequence: Synthetic peptide
LFSSPSQWENL

SEQ ID NO: 286 - protein, 11 aa, Artificial Sequence
  Description of Artificial Sequence: Synthetic peptide
LFSSPSHPENL

SEQ ID NO: 287 - protein, 11 aa, Artificial Sequence
  Description of Artificial Sequence: Synthetic peptide
LFSSPSHFENL

SEQ ID NO: 288 - protein, 11 aa, Artificial Sequence
  Description of Artificial Sequence: Synthetic peptide
LFSSPSHYENL

SEQ ID NO: 289 - protein, 11 aa, Artificial Sequence
  Description of Artificial Sequence: Synthetic peptide
LFSSPSHWENL

SEQ ID NO: 290 - protein, 11 aa, Artificial Sequence
  Description of Artificial Sequence: Synthetic peptide
LFTSPSMPENL

SEQ ID NO: 291 - protein, 11 aa, Artificial Sequence
  Description of Artificial Sequence: Synthetic peptide
LFTSPSMFENL

SEQ ID NO: 292 - protein, 11 aa, Artificial Sequence
  Description of Artificial Sequence: Synthetic peptide
LFTSPSMYENL

SEQ ID NO: 293 - protein, 11 aa, Artificial Sequence
  Description of Artificial Sequence: Synthetic peptide
LFTSPSMWENL

SEQ ID NO: 294 - protein, 11 aa, Artificial Sequence
  Description of Artificial Sequence: Synthetic peptide
LFTSPSFPENL

SEQ ID NO: 295 - protein, 11 aa, Artificial Sequence
  Description of Artificial Sequence: Synthetic peptide
LFTSPSFFENL

SEQ ID NO: 296 - protein, 11 aa, Artificial Sequence
  Description of Artificial Sequence: Synthetic peptide
LFTSPSFYENL

SEQ ID NO: 297 - protein, 11 aa, Artificial Sequence
  Description of Artificial Sequence: Synthetic peptide
LFTSPSFWENL

SEQ ID NO: 298 - protein, 11 aa, Artificial Sequence
  Description of Artificial Sequence: Synthetic peptide
LFTSPSYPENL

SEQ ID NO: 299 - protein, 11 aa, Artificial Sequence
  Description of Artificial Sequence: Synthetic peptide
LFTSPSYFENL

SEQ ID NO: 300 - protein, 11 aa, Artificial Sequence
  Description of Artificial Sequence: Synthetic peptide
LFTSPSYYENL

SEQ ID NO: 301 - protein, 11 aa, Artificial Sequence
  Description of Artificial Sequence: Synthetic peptide
LFTSPSYWENL

SEQ ID NO: 302 - protein, 11 aa, Artificial Sequence
  Description of Artificial Sequence: Synthetic peptide
LFTSPSDPENL

SEQ ID NO: 303 - protein, 11 aa, Artificial Sequence
  Description of Artificial Sequence: Synthetic peptide
LFTSPSDFENL

SEQ ID NO: 304 - protein, 11 aa, Artificial Sequence
  Description of Artificial Sequence: Synthetic peptide
LFTSPSDYENL

SEQ ID NO: 305 - protein, 11 aa, Artificial Sequence
  Description of Artificial Sequence: Synthetic peptide
LFTSPSDWENL

SEQ ID NO: 306 - protein, 11 aa, Artificial Sequence
  Description of Artificial Sequence: Synthetic peptide
LFTSPSEPENL

SEQ ID NO: 307 - protein, 11 aa, Artificial Sequence
  Description of Artificial Sequence: Synthetic peptide
LFTSPSEFENL

SEQ ID NO: 308 - protein, 11 aa, Artificial Sequence
  Description of Artificial Sequence: Synthetic peptide
LFTSPSEYENL

SEQ ID NO: 309 - protein, 11 aa, Artificial Sequence
  Description of Artificial Sequence: Synthetic peptide
LFTSPSEWENL

SEQ ID NO: 310 - protein, 11 aa, Artificial Sequence
  Description of Artificial Sequence: Synthetic peptide
LFTSPSNPENL

SEQ ID NO: 311 - protein, 11 aa, Artificial Sequence
  Description of Artificial Sequence: Synthetic peptide
LFTSPSNFENL

SEQ ID NO: 312 - protein, 11 aa, Artificial Sequence
  Description of Artificial Sequence: Synthetic peptide
LFTSPSNYENL

SEQ ID NO: 313 - protein, 11 aa, Artificial Sequence
  Description of Artificial Sequence: Synthetic peptide
LFTSPSNWENL

SEQ ID NO: 314 - protein, 11 aa, Artificial Sequence
  Description of Artificial Sequence: Synthetic peptide
LFTSPSQPENL

SEQ ID NO: 315 - protein, 11 aa, Artificial Sequence
  Description of Artificial Sequence: Synthetic peptide
LFTSPSQFENL

SEQ ID NO: 316 - protein, 11 aa, Artificial Sequence
  Description of Artificial Sequence: Synthetic peptide
LFTSPSQYENL

SEQ ID NO: 317 - protein, 11 aa, Artificial Sequence
  Description of Artificial Sequence: Synthetic peptide
LFTSPSQWENL

SEQ ID NO: 318 - protein, 11 aa, Artificial Sequence
  Description of Artificial Sequence: Synthetic peptide
LFTSPSHPENL

SEQ ID NO: 319 - protein, 11 aa, Artificial Sequence
  Description of Artificial Sequence: Synthetic peptide
LFTSPSHFENL

SEQ ID NO: 320 - protein, 11 aa, Artificial Sequence
  Description of Artificial Sequence: Synthetic peptide
LFTSPSHYENL

SEQ ID NO: 321 - protein, 11 aa, Artificial Sequence
  Description of Artificial Sequence: Synthetic peptide
LFTSPSHWENL

SEQ ID NO: 322 - protein, 11 aa, Artificial Sequence
  Description of Artificial Sequence: Synthetic peptide
LFHSPSMPENL

SEQ ID NO: 323 - protein, 11 aa, Artificial Sequence
  Description of Artificial Sequence: Synthetic peptide
LFHSPSMFENL

SEQ ID NO: 324 - protein, 11 aa, Artificial Sequence
  Description of Artificial Sequence: Synthetic peptide
LFHSPSMYENL

SEQ ID NO: 325 - protein, 11 aa, Artificial Sequence
  Description of Artificial Sequence: Synthetic peptide
LFHSPSMWENL

SEQ ID NO: 326 - protein, 11 aa, Artificial Sequence
  Description of Artificial Sequence: Synthetic peptide
LFHSPSFPENL

SEQ ID NO: 327 - protein, 11 aa, Artificial Sequence
  Description of Artificial Sequence: Synthetic peptide
LFHSPSFFENL

SEQ ID NO: 328 - protein, 11 aa, Artificial Sequence
  Description of Artificial Sequence: Synthetic peptide
LFHSPSFYENL

SEQ ID NO: 329 - protein, 11 aa, Artificial Sequence
  Description of Artificial Sequence: Synthetic peptide
LFHSPSFWENL

SEQ ID NO: 330 - protein, 11 aa, Artificial Sequence
  Description of Artificial Sequence: Synthetic peptide
LFHSPSYPENL

SEQ ID NO: 331 - protein, 11 aa, Artificial Sequence
  Description of Artificial Sequence: Synthetic peptide
LFHSPSYFENL

SEQ ID NO: 332 - protein, 11 aa, Artificial Sequence
  Description of Artificial Sequence: Synthetic peptide
LFHSPSYYENL

SEQ ID NO: 333 - protein, 11 aa, Artificial Sequence
  Description of Artificial Sequence: Synthetic peptide
LFHSPSYWENL

SEQ ID NO: 334 - protein, 11 aa, Artificial Sequence
  Description of Artificial Sequence: Synthetic peptide
LFHSPSDPENL

SEQ ID NO: 335 - protein, 11 aa, Artificial Sequence
  Description of Artificial Sequence: Synthetic peptide
LFHSPSDFENL

SEQ ID NO: 336 - protein, 11 aa, Artificial Sequence
  Description of Artificial Sequence: Synthetic peptide
LFHSPSDYENL

SEQ ID NO: 337 - protein, 11 aa, Artificial Sequence
  Description of Artificial Sequence: Synthetic peptide
LFHSPSDWENL

SEQ ID NO: 338 - protein, 11 aa, Artificial Sequence
  Description of Artificial Sequence: Synthetic peptide
LFHSPSEPENL

SEQ ID NO: 339 - protein, 11 aa, Artificial Sequence
  Description of Artificial Sequence: Synthetic peptide
LFHSPSEFENL

SEQ ID NO: 340 - protein, 11 aa, Artificial Sequence
  Description of Artificial Sequence: Synthetic peptide
LFHSPSEYENL

SEQ ID NO: 341 - protein, 11 aa, Artificial Sequence
  Description of Artificial Sequence: Synthetic peptide
LFHSPSEWENL

SEQ ID NO: 342 - protein, 11 aa, Artificial Sequence
  Description of Artificial Sequence: Synthetic peptide
LFHSPSNPENL

SEQ ID NO: 343 - protein, 11 aa, Artificial Sequence
  Description of Artificial Sequence: Synthetic peptide
LFHSPSNFENL

SEQ ID NO: 344 - protein, 11 aa, Artificial Sequence
  Description of Artificial Sequence: Synthetic peptide
LFHSPSNYENL

SEQ ID NO: 345 - protein, 11 aa, Artificial Sequence
  Description of Artificial Sequence: Synthetic peptide
LFHSPSNWENL

SEQ ID NO: 346 - protein, 11 aa, Artificial Sequence
  Description of Artificial Sequence: Synthetic peptide
LFHSPSQPENL

SEQ ID NO: 347 - protein, 11 aa, Artificial Sequence
  Description of Artificial Sequence: Synthetic peptide
LFHSPSQFENL

SEQ ID NO: 348 - protein, 11 aa, Artificial Sequence
  Description of Artificial Sequence: Synthetic peptide
LFHSPSQYENL

SEQ ID NO: 349 - protein, 11 aa, Artificial Sequence
  Description of Artificial Sequence: Synthetic peptide
LFHSPSQWENL

SEQ ID NO: 350 - protein, 11 aa, Artificial Sequence
  Description of Artificial Sequence: Synthetic peptide
LFHSPSHPENL

SEQ ID NO: 351 - protein, 11 aa, Artificial Sequence
  Description of Artificial Sequence: Synthetic peptide
LFHSPSHFENL

SEQ ID NO: 352 - protein, 11 aa, Artificial Sequence
  Description of Artificial Sequence: Synthetic peptide
LFHSPSHYENL

SEQ ID NO: 353 - protein, 11 aa, Artificial Sequence
  Description of Artificial Sequence: Synthetic peptide
LFHSPSHWENL

SEQ ID NO: 354 - protein, 11 aa, Artificial Sequence
  Description of Artificial Sequence: Synthetic peptide
LFNSPSMPENL

SEQ ID NO: 355 - protein, 11 aa, Artificial Sequence
  Description of Artificial Sequence: Synthetic peptide
LFNSPSMFENL

SEQ ID NO: 356 - protein, 11 aa, Artificial Sequence
  Description of Artificial Sequence: Synthetic peptide
LFNSPSMYENL

SEQ ID NO: 357 - protein, 11 aa, Artificial Sequence
  Description of Artificial Sequence: Synthetic peptide
LFNSPSMWENL

SEQ ID NO: 358 - protein, 11 aa, Artificial Sequence
  Description of Artificial Sequence: Synthetic peptide
LFNSPSFPENL

SEQ ID NO: 359 - protein, 11 aa, Artificial Sequence
  Description of Artificial Sequence: Synthetic peptide
LFNSPSFFENL

SEQ ID NO: 360 - protein, 11 aa, Artificial Sequence
  Description of Artificial Sequence: Synthetic peptide
LFNSPSFYENL

SEQ ID NO: 361 - protein, 11 aa, Artificial Sequence
  Description of Artificial Sequence: Synthetic peptide
LFNSPSFWENL

SEQ ID NO: 362 - protein, 11 aa, Artificial Sequence
  Description of Artificial Sequence: Synthetic peptide
LFNSPSYPENL

SEQ ID NO: 363 - protein, 11 aa, Artificial Sequence
  Description of Artificial Sequence: Synthetic peptide
LFNSPSYFENL

SEQ ID NO: 364 - protein, 11 aa, Artificial Sequence
  Description of Artificial Sequence: Synthetic peptide
LFNSPSYYENL

SEQ ID NO: 365 - protein, 11 aa, Artificial Sequence
  Description of Artificial Sequence: Synthetic peptide
LFNSPSYWENL

SEQ ID NO: 366 - protein, 11 aa, Artificial Sequence
  Description of Artificial Sequence: Synthetic peptide
LFNSPSDPENL

SEQ ID NO: 367 - protein, 11 aa, Artificial Sequence
  Description of Artificial Sequence: Synthetic peptide
LFNSPSDFENL

SEQ ID NO: 368 - protein, 11 aa, Artificial Sequence
  Description of Artificial Sequence: Synthetic peptide
LFNSPSDYENL

SEQ ID NO: 369 - protein, 11 aa, Artificial Sequence
  Description of Artificial Sequence: Synthetic peptide
LFNSPSDWENL

SEQ ID NO: 370 - protein, 11 aa, Artificial Sequence
  Description of Artificial Sequence: Synthetic peptide
LFNSPSEPENL

SEQ ID NO: 371 - protein, 11 aa, Artificial Sequence
  Description of Artificial Sequence: Synthetic peptide
LFNSPSEFENL

SEQ ID NO: 372 - protein, 11 aa, Artificial Sequence
  Description of Artificial Sequence: Synthetic peptide
LFNSPSEYENL

SEQ ID NO: 373 - protein, 11 aa, Artificial Sequence
  Description of Artificial Sequence: Synthetic peptide
LFNSPSEWENL

SEQ ID NO: 374 - protein, 11 aa, Artificial Sequence
  Description of Artificial Sequence: Synthetic peptide
LFNSPSNPENL

SEQ ID NO: 375 - protein, 11 aa, Artificial Sequence
  Description of Artificial Sequence: Synthetic peptide
LFNSPSNFENL

SEQ ID NO: 376 - protein, 11 aa, Artificial Sequence
  Description of Artificial Sequence: Synthetic peptide
LFNSPSNYENL

SEQ ID NO: 377 - protein, 11 aa, Artificial Sequence
  Description of Artificial Sequence: Synthetic peptide
LFNSPSNWENL

SEQ ID NO: 378 - protein, 11 aa, Artificial Sequence
  Description of Artificial Sequence: Synthetic peptide
LFNSPSQPENL

SEQ ID NO: 379 - protein, 11 aa, Artificial Sequence
  Description of Artificial Sequence: Synthetic peptide
LFNSPSQFENL

SEQ ID NO: 380 - protein, 11 aa, Artificial Sequence
  Description of Artificial Sequence: Synthetic peptide
LFNSPSQYENL

SEQ ID NO: 381 - protein, 11 aa, Artificial Sequence
  Description of Artificial Sequence: Synthetic peptide
LFNSPSQWENL

SEQ ID NO: 382 - protein, 11 aa, Artificial Sequence
  Description of Artificial Sequence: Synthetic peptide
LFNSPSHPENL

SEQ ID NO: 383 - protein, 11 aa, Artificial Sequence
  Description of Artificial Sequence: Synthetic peptide
LFNSPSHFENL

SEQ ID NO: 384 - protein, 11 aa, Artificial Sequence
  Description of Artificial Sequence: Synthetic peptide
LFNSPSHYENL

SEQ ID NO: 385 - protein, 11 aa, Artificial Sequence
  Description of Artificial Sequence: Synthetic peptide
LFNSPSHWENL

SEQ ID NO: 386 - protein, 11 aa, Artificial Sequence
  Description of Artificial Sequence: Synthetic peptide
LFGSPSMPENL

SEQ ID NO: 387 - protein, 11 aa, Artificial Sequence
  Description of Artificial Sequence: Synthetic peptide
LFGSPSMFENL

SEQ ID NO: 388 - protein, 11 aa, Artificial Sequence
  Description of Artificial Sequence: Synthetic peptide
LFGSPSMYENL

SEQ ID NO: 389 - protein, 11 aa, Artificial Sequence
  Description of Artificial Sequence: Synthetic peptide
LFGSPSMWENL

SEQ ID NO: 390 - protein, 11 aa, Artificial Sequence
  Description of Artificial Sequence: Synthetic peptide
LFGSPSFPENL

SEQ ID NO: 391 - protein, 11 aa, Artificial Sequence
  Description of Artificial Sequence: Synthetic peptide
LFGSPSFFENL

SEQ ID NO: 392 - protein, 11 aa, Artificial Sequence
  Description of Artificial Sequence: Synthetic peptide
LFGSPSFYENL

SEQ ID NO: 393 - protein, 11 aa, Artificial Sequence
  Description of Artificial Sequence: Synthetic peptide
LFGSPSFWENL

SEQ ID NO: 394 - protein, 11 aa, Artificial Sequence
  Description of Artificial Sequence: Synthetic peptide
LFGSPSYPENL

SEQ ID NO: 395 - protein, 11 aa, Artificial Sequence
  Description of Artificial Sequence: Synthetic peptide
LFGSPSYFENL

SEQ ID NO: 396 - protein, 11 aa, Artificial Sequence
  Description of Artificial Sequence: Synthetic peptide
LFGSPSYYENL

SEQ ID NO: 397 - protein, 11 aa, Artificial Sequence
  Description of Artificial Sequence: Synthetic peptide
LFGSPSYWENL

SEQ ID NO: 398 - protein, 11 aa, Artificial Sequence
  Description of Artificial Sequence: Synthetic peptide
LFGSPSDPENL

SEQ ID NO: 399 - protein, 11 aa, Artificial Sequence
  Description of Artificial Sequence: Synthetic peptide
LFGSPSDFENL

SEQ ID NO: 400 - protein, 11 aa, Artificial Sequence
  Description of Artificial Sequence: Synthetic peptide
LFGSPSDYENL

SEQ ID NO: 401 - protein, 11 aa, Artificial Sequence
  Description of Artificial Sequence: Synthetic peptide
LFGSPSDWENL

SEQ ID NO: 402 - protein, 11 aa, Artificial Sequence
  Description of Artificial Sequence: Synthetic peptide
LFGSPSEPENL

SEQ ID NO: 403 - protein, 11 aa, Artificial Sequence
  Description of Artificial Sequence: Synthetic peptide
LFGSPSEFENL

SEQ ID NO: 404 - protein, 11 aa, Artificial Sequence
  Description of Artificial Sequence: Synthetic peptide
LFGSPSEYENL

SEQ ID NO: 405 - protein, 11 aa, Artificial Sequence
  Description of Artificial Sequence: Synthetic peptide
LFGSPSEWENL

SEQ ID NO: 406 - protein, 11 aa, Artificial Sequence
  Description of Artificial Sequence: Synthetic peptide
LFGSPSNPENL

SEQ ID NO: 407 - protein, 11 aa, Artificial Sequence
  Description of Artificial Sequence: Synthetic peptide
LFGSPSNFENL

SEQ ID NO: 408 - protein, 11 aa, Artificial Sequence
  Description of Artificial Sequence: Synthetic peptide
LFGSPSNYENL

SEQ ID NO: 409 - protein, 11 aa, Artificial Sequence
  Description of Artificial Sequence: Synthetic peptide
LFGSPSNWENL

SEQ ID NO: 410 - protein, 11 aa, Artificial Sequence
  Description of Artificial Sequence: Synthetic peptide
LFGSPSQPENL

SEQ ID NO: 411 - protein, 11 aa, Artificial Sequence
  Description of Artificial Sequence: Synthetic peptide
LFGSPSQFENL

SEQ ID NO: 412 - protein, 11 aa, Artificial Sequence
  Description of Artificial Sequence: Synthetic peptide
LFGSPSQYENL

SEQ ID NO: 413 - protein, 11 aa, Artificial Sequence
  Description of Artificial Sequence: Synthetic peptide
LFGSPSQWENL

SEQ ID NO: 414 - protein, 11 aa, Artificial Sequence
  Description of Artificial Sequence: Synthetic peptide
LFGSPSHPENL

SEQ ID NO: 415 - protein, 11 aa, Artificial Sequence
  Description of Artificial Sequence: Synthetic peptide
LFGSPSHFENL

SEQ ID NO: 416 - protein, 11 aa, Artificial Sequence
  Description of Artificial Sequence: Synthetic peptide
LFGSPSHYENL

SEQ ID NO: 417 - protein, 11 aa, Artificial Sequence
  Description of Artificial Sequence: Synthetic peptide
LFGSPSHWENL

SEQ ID NO: 418 - protein, 11 aa, Artificial Sequence
  Description of Artificial Sequence: Synthetic peptide
LFASPSMPENL

SEQ ID NO: 419 - protein, 11 aa, Artificial Sequence
  Description of Artificial Sequence: Synthetic peptide
LFASPSMFENL

SEQ ID NO: 420 - protein, 11 aa, Artificial Sequence
  Description of Artificial Sequence: Synthetic peptide
LFASPSMYENL

SEQ ID NO: 421 - protein, 11 aa, Artificial Sequence
  Description of Artificial Sequence: Synthetic peptide
LFASPSMWENL

SEQ ID NO: 422 - protein, 11 aa, Artificial Sequence
  Description of Artificial Sequence: Synthetic peptide
LFASPSFPENL

SEQ ID NO: 423 - protein, 11 aa, Artificial Sequence
  Description of Artificial Sequence: Synthetic peptide
LFASPSFFENL

SEQ ID NO: 424 - protein, 11 aa, Artificial Sequence
  Description of Artificial Sequence: Synthetic peptide
LFASPSFYENL

SEQ ID NO: 425 - protein, 11 aa, Artificial Sequence
  Description of Artificial Sequence: Synthetic peptide
LFASPSFWENL

SEQ ID NO: 426 - protein, 11 aa, Artificial Sequence
  Description of Artificial Sequence: Synthetic peptide
LFASPSYPENL

SEQ ID NO: 427 - protein, 11 aa, Artificial Sequence
  Description of Artificial Sequence: Synthetic peptide
LFASPSYFENL

SEQ ID NO: 428 - protein, 11 aa, Artificial Sequence
  Description of Artificial Sequence: Synthetic peptide
LFASPSYYENL

SEQ ID NO: 429 - protein, 11 aa, Artificial Sequence
  Description of Artificial Sequence: Synthetic peptide
LFASPSYWENL

SEQ ID NO: 430 - protein, 11 aa, Artificial Sequence
  Description of Artificial Sequence: Synthetic peptide
LFASPSDPENL

SEQ ID NO: 431 - protein, 11 aa, Artificial Sequence
  Description of Artificial Sequence: Synthetic peptide
LFASPSDFENL

SEQ ID NO: 432 - protein, 11 aa, Artificial Sequence
  Description of Artificial Sequence: Synthetic peptide
LFASPSDYENL

SEQ ID NO: 433 - protein, 11 aa, Artificial Sequence
  Description of Artificial Sequence: Synthetic peptide
LFASPSDWENL

SEQ ID NO: 434 - protein, 11 aa, Artificial Sequence
  Description of Artificial Sequence: Synthetic peptide
LFASPSEPENL

SEQ ID NO: 435 - protein, 11 aa, Artificial Sequence
  Description of Artificial Sequence: Synthetic peptide
LFASPSEFENL

SEQ ID NO: 436 - protein, 11 aa, Artificial Sequence
  Description of Artificial Sequence: Synthetic peptide
LFASPSEYENL

SEQ ID NO: 437 - protein, 11 aa, Artificial Sequence
  Description of Artificial Sequence: Synthetic peptide
LFASPSEWENL

SEQ ID NO: 438 - protein, 11 aa, Artificial Sequence
  Description of Artificial Sequence: Synthetic peptide
LFASPSNPENL

SEQ ID NO: 439 - protein, 11 aa, Artificial Sequence
  Description of Artificial Sequence: Synthetic peptide
LFASPSNFENL

SEQ ID NO: 440 - protein, 11 aa, Artificial Sequence
  Description of Artificial Sequence: Synthetic peptide
LFASPSNYENL

SEQ ID NO: 441 - protein, 11 aa, Artificial Sequence
  Description of Artificial Sequence: Synthetic peptide
LFASPSNWENL

SEQ ID NO: 442 - protein, 11 aa, Artificial Sequence
  Description of Artificial Sequence: Synthetic peptide
LFASPSQPENL

SEQ ID NO: 443 - protein, 11 aa, Artificial Sequence
  Description of Artificial Sequence: Synthetic peptide
LFASPSQFENL

SEQ ID NO: 444 - protein, 11 aa, Artificial Sequence
  Description of Artificial Sequence: Synthetic peptide
LFASPSQYENL

SEQ ID NO: 445 - protein, 11 aa, Artificial Sequence
  Description of Artificial Sequence: Synthetic peptide
LFASPSQWENL

SEQ ID NO: 446 - protein, 11 aa, Artificial Sequence
  Description of Artificial Sequence: Synthetic peptide
LFASPSHPENL

SEQ ID NO: 447 - protein, 11 aa, Artificial Sequence
  Description of Artificial Sequence: Synthetic peptide
LFASPSHFENL

SEQ ID NO: 448 - protein, 11 aa, Artificial Sequence
  Description of Artificial Sequence: Synthetic peptide
LFASPSHYENL

SEQ ID NO: 449 - protein, 11 aa, Artificial Sequence
  Description of Artificial Sequence: Synthetic peptide
LFASPSHWENL

SEQ ID NO: 450 - protein, 11 aa, Artificial Sequence
  Description of Artificial Sequence: Synthetic peptide
FYRSPSMPENL

SEQ ID NO: 451 - protein, 11 aa, Artificial Sequence
  Description of Artificial Sequence: Synthetic peptide
FYRSPSMFENL

SEQ ID NO: 452 - protein, 11 aa, Artificial Sequence
  Description of Artificial Sequence: Synthetic peptide
FYRSPSMYENL

SEQ ID NO: 453 - protein, 11 aa, Artificial Sequence
  Description of Artificial Sequence: Synthetic peptide
FYRSPSMWENL

SEQ ID NO: 454 - protein, 11 aa, Artificial Sequence
  Description of Artificial Sequence: Synthetic peptide
FYRSPSFPENL

SEQ ID NO: 455 - protein, 11 aa, Artificial Sequence
  Description of Artificial Sequence: Synthetic peptide
FYRSPSFFENL

SEQ ID NO: 456 - protein, 11 aa, Artificial Sequence
  Description of Artificial Sequence: Synthetic peptide
FYRSPSFYENL

SEQ ID NO: 457 - protein, 11 aa, Artificial Sequence
  Description of Artificial Sequence: Synthetic peptide
FYRSPSFWENL

SEQ ID NO: 458 - protein, 11 aa, Artificial Sequence
  Description of Artificial Sequence: Synthetic peptide
FYRSPSYPENL

SEQ ID NO: 459 - protein, 11 aa, Artificial Sequence
  Description of Artificial Sequence: Synthetic peptide
FYRSPSYFENL

SEQ ID NO: 460 - protein, 11 aa, Artificial Sequence
  Description of Artificial Sequence: Synthetic peptide
FYRSPSYYENL

SEQ ID NO: 461 - protein, 11 aa, Artificial Sequence
  Description of Artificial Sequence: Synthetic peptide
FYRSPSYWENL

SEQ ID NO: 462 - protein, 11 aa, Artificial Sequence
  Description of Artificial Sequence: Synthetic peptide
FYRSPSDPENL

SEQ ID NO: 463 - protein, 11 aa, Artificial Sequence
  Description of Artificial Sequence: Synthetic peptide
FYRSPSDFENL

SEQ ID NO: 464 - protein, 11 aa, Artificial Sequence
  Description of Artificial Sequence: Synthetic peptide
FYRSPSDYENL

SEQ ID NO: 465 - protein, 11 aa, Artificial Sequence
  Description of Artificial Sequence: Synthetic peptide
FYRSPSDWENL

SEQ ID NO: 466 - protein, 11 aa, Artificial Sequence
  Description of Artificial Sequence: Synthetic peptide
FYRSPSEPENL

SEQ ID NO: 467 - protein, 11 aa, Artificial Sequence
  Description of Artificial Sequence: Synthetic peptide
FYRSPSEFENL

SEQ ID NO: 468 - protein, 11 aa, Artificial Sequence
  Description of Artificial Sequence: Synthetic peptide
FYRSPSEYENL

SEQ ID NO: 469 - protein, 11 aa, Artificial Sequence
  Description of Artificial Sequence: Synthetic peptide
FYRSPSEWENL

SEQ ID NO: 470 - protein, 11 aa, Artificial Sequence
  Description of Artificial Sequence: Synthetic peptide
FYRSPSNPENL

SEQ ID NO: 471 - protein, 11 aa, Artificial Sequence
  Description of Artificial Sequence: Synthetic peptide
FYRSPSNFENL

SEQ ID NO: 472 - protein, 11 aa, Artificial Sequence
  Description of Artificial Sequence: Synthetic peptide
FYRSPSNYENL

SEQ ID NO: 473 - protein, 11 aa, Artificial Sequence
  Description of Artificial Sequence: Synthetic peptide
FYRSPSNWENL

SEQ ID NO: 474 - protein, 11 aa, Artificial Sequence
  Description of Artificial Sequence: Synthetic peptide
FYRSPSQPENL

SEQ ID NO: 475 - protein, 11 aa, Artificial Sequence
  Description of Artificial Sequence: Synthetic peptide
FYRSPSQFENL

SEQ ID NO: 476 - protein, 11 aa, Artificial Sequence
  Description of Artificial Sequence: Synthetic peptide
FYRSPSQYENL

SEQ ID NO: 477 - protein, 11 aa, Artificial Sequence
  Description of Artificial Sequence: Synthetic peptide
FYRSPSQWENL

SEQ ID NO: 478 - protein, 11 aa, Artificial Sequence
  Description of Artificial Sequence: Synthetic peptide
FYRSPSHPENL

SEQ ID NO: 479 - protein, 11 aa, Artificial Sequence
  Description of Artificial Sequence: Synthetic peptide
FYRSPSHFENL

SEQ ID NO: 480 - protein, 11 aa, Artificial Sequence
  Description of Artificial Sequence: Synthetic peptide
FYRSPSHYENL

SEQ ID NO: 481 - protein, 11 aa, Artificial Sequence
  Description of Artificial Sequence: Synthetic peptide
FYRSPSHWENL

SEQ ID NO: 482 - protein, 11 aa, Artificial Sequence
  Description of Artificial Sequence: Synthetic peptide
FYSSPSMPENL

SEQ ID NO: 483 - protein, 11 aa, Artificial Sequence
  Description of Artificial Sequence: Synthetic peptide
FYSSPSMFENL

SEQ ID NO: 484 - protein, 11 aa, Artificial Sequence
  Description of Artificial Sequence: Synthetic peptide
FYSSPSMYENL

SEQ ID NO: 485 - protein, 11 aa, Artificial Sequence
  Description of Artificial Sequence: Synthetic peptide
FYSSPSMWENL

SEQ ID NO: 486 - protein, 11 aa, Artificial Sequence
  Description of Artificial Sequence: Synthetic peptide
FYSSPSFPENL

SEQ ID NO: 487 - protein, 11 aa, Artificial Sequence
  Description of Artificial Sequence: Synthetic peptide
FYSSPSFFENL

SEQ ID NO: 488 - protein, 11 aa, Artificial Sequence
  Description of Artificial Sequence: Synthetic peptide
FYSSPSFYENL

SEQ ID NO: 489 - protein, 11 aa, Artificial Sequence
  Description of Artificial Sequence: Synthetic peptide
FYSSPSFWENL

SEQ ID NO: 490 - protein, 11 aa, Artificial Sequence
  Description of Artificial Sequence: Synthetic peptide
FYSSPSYPENL

SEQ ID NO: 491 - protein, 11 aa, Artificial Sequence
  Description of Artificial Sequence: Synthetic peptide
FYSSPSYFENL

SEQ ID NO: 492 - protein, 11 aa, Artificial Sequence
  Description of Artificial Sequence: Synthetic peptide
FYSSPSYYENL

SEQ ID NO: 493 - protein, 11 aa, Artificial Sequence
  Description of Artificial Sequence: Synthetic peptide
FYSSPSYWENL

SEQ ID NO: 494 - protein, 11 aa, Artificial Sequence
  Description of Artificial Sequence: Synthetic peptide
FYSSPSDPENL

SEQ ID NO: 495 - protein, 11 aa, Artificial Sequence
  Description of Artificial Sequence: Synthetic peptide
FYSSPSDFENL

SEQ ID NO: 496 - protein, 11 aa, Artificial Sequence
  Description of Artificial Sequence: Synthetic peptide
FYSSPSDYENL

SEQ ID NO: 497 - protein, 11 aa, Artificial Sequence
  Description of Artificial Sequence: Synthetic peptide
FYSSPSDWENL

SEQ ID NO: 498 - protein, 11 aa, Artificial Sequence
  Description of Artificial Sequence: Synthetic peptide
FYSSPSEPENL

SEQ ID NO: 499 - protein, 11 aa, Artificial Sequence
  Description of Artificial Sequence: Synthetic peptide
FYSSPSEFENL

SEQ ID NO: 500 - protein, 11 aa, Artificial Sequence
  Description of Artificial Sequence: Synthetic peptide
FYSSPSEYENL

SEQ ID NO: 501 - protein, 11 aa, Artificial Sequence
  Description of Artificial Sequence: Synthetic peptide
FYSSPSEWENL

SEQ ID NO: 502 - protein, 11 aa, Artificial Sequence
  Description of Artificial Sequence: Synthetic peptide
FYSSPSNPENL

SEQ ID NO: 503 - protein, 11 aa, Artificial Sequence
  Description of Artificial Sequence: Synthetic peptide
FYSSPSNFENL

SEQ ID NO: 504 - protein, 11 aa, Artificial Sequence
  Description of Artificial Sequence: Synthetic peptide
FYSSPSNYENL

SEQ ID NO: 505 - protein, 11 aa, Artificial Sequence
  Description of Artificial Sequence: Synthetic peptide
FYSSPSNWENL

SEQ ID NO: 506 - protein, 11 aa, Artificial Sequence
  Description of Artificial Sequence: Synthetic peptide
FYSSPSQPENL

SEQ ID NO: 507 - protein, 11 aa, Artificial Sequence
  Description of Artificial Sequence: Synthetic peptide
FYSSPSQFENL

SEQ ID NO: 508 - protein, 11 aa, Artificial Sequence
  Description of Artificial Sequence: Synthetic peptide
FYSSPSQYENL

SEQ ID NO: 509 - protein, 11 aa, Artificial Sequence
  Description of Artificial Sequence: Synthetic peptide
FYSSPSQWENL

SEQ ID NO: 510 - protein, 11 aa, Artificial Sequence
  Description of Artificial Sequence: Synthetic peptide
FYSSPSHPENL

SEQ ID NO: 511 - protein, 11 aa, Artificial Sequence
  Description of Artificial Sequence: Synthetic peptide
FYSSPSHFENL

SEQ ID NO: 512 - protein, 11 aa, Artificial Sequence
  Description of Artificial Sequence: Synthetic peptide
FYSSPSHYENL

SEQ ID NO: 513 - protein, 11 aa, Artificial Sequence
  Description of Artificial Sequence: Synthetic peptide
FYSSPSHWENL

SEQ ID NO: 514 - protein, 11 aa, Artificial Sequence
  Description of Artificial Sequence: Synthetic peptide
FYTSPSMPENL

SEQ ID NO: 515 - protein, 11 aa, Artificial Sequence
  Description of Artificial Sequence: Synthetic peptide
FYTSPSMFENL

SEQ ID NO: 516 - protein, 11 aa, Artificial Sequence
  Description of Artificial Sequence: Synthetic peptide
FYTSPSMYENL

SEQ ID NO: 517 - protein, 11 aa, Artificial Sequence
  Description of Artificial Sequence: Synthetic peptide
FYTSPSMWENL

SEQ ID NO: 518 - protein, 11 aa, Artificial Sequence
  Description of Artificial Sequence: Synthetic peptide
FYTSPSFPENL

SEQ ID NO: 519 - protein, 11 aa, Artificial Sequence
  Description of Artificial Sequence: Synthetic peptide
FYTSPSFFENL

SEQ ID NO: 520 - protein, 11 aa, Artificial Sequence
  Description of Artificial Sequence: Synthetic peptide
FYTSPSFYENL

SEQ ID NO: 521 - protein, 11 aa, Artificial Sequence
  Description of Artificial Sequence: Synthetic peptide
FYTSPSFWENL

SEQ ID NO: 522 - protein, 11 aa, Artificial Sequence
  Description of Artificial Sequence: Synthetic peptide
FYTSPSYPENL

SEQ ID NO: 523 - protein, 11 aa, Artificial Sequence
  Description of Artificial Sequence: Synthetic peptide
FYTSPSYFENL

SEQ ID NO: 524 - protein, 11 aa, Artificial Sequence
  Description of Artificial Sequence: Synthetic peptide
FYTSPSYYENL

SEQ ID NO: 525 - protein, 11 aa, Artificial Sequence
  Description of Artificial Sequence: Synthetic peptide
FYTSPSYWENL

SEQ ID NO: 526 - protein, 11 aa, Artificial Sequence
  Description of Artificial Sequence: Synthetic peptide
FYTSPSDPENL

SEQ ID NO: 527 - protein, 11 aa, Artificial Sequence
  Description of Artificial Sequence: Synthetic peptide
FYTSPSDFENL

SEQ ID NO: 528 - protein, 11 aa, Artificial Sequence
  Description of Artificial Sequence: Synthetic peptide
FYTSPSDYENL

SEQ ID NO: 529 - protein, 11 aa, Artificial Sequence
  Description of Artificial Sequence: Synthetic peptide
FYTSPSDWENL

SEQ ID NO: 530 - protein, 11 aa, Artificial Sequence
  Description of Artificial Sequence: Synthetic peptide
FYTSPSEPENL

SEQ ID NO: 531 - protein, 11 aa, Artificial Sequence
  Description of Artificial Sequence: Synthetic peptide
FYTSPSEFENL

SEQ ID NO: 532 - protein, 11 aa, Artificial Sequence
  Description of Artificial Sequence: Synthetic peptide
FYTSPSEYENL

SEQ ID NO: 533 - protein, 11 aa, Artificial Sequence
  Description of Artificial Sequence: Synthetic peptide
FYTSPSEWENL

SEQ ID NO: 534 - protein, 11 aa, Artificial Sequence
  Description of Artificial Sequence: Synthetic peptide
FYTSPSNPENL

SEQ ID NO: 535 - protein, 11 aa, Artificial Sequence
  Description of Artificial Sequence: Synthetic peptide
FYTSPSNFENL

SEQ ID NO: 536 - protein, 11 aa, Artificial Sequence
  Description of Artificial Sequence: Synthetic peptide
FYTSPSNYENL

SEQ ID NO: 537 - protein, 11 aa, Artificial Sequence
  Description of Artificial Sequence: Synthetic peptide
FYTSPSNWENL

SEQ ID NO: 538 - protein, 11 aa, Artificial Sequence
  Description of Artificial Sequence: Synthetic peptide
FYTSPSQPENL

SEQ ID NO: 539 - protein, 11 aa, Artificial Sequence
  Description of Artificial Sequence: Synthetic peptide
FYTSPSQFENL

SEQ ID NO: 540 - protein, 11 aa, Artificial Sequence
  Description of Artificial Sequence: Synthetic peptide
FYTSPSQYENL

SEQ ID NO: 541 - protein, 11 aa, Artificial Sequence
  Description of Artificial Sequence: Synthetic peptide
FYTSPSQWENL

SEQ ID NO: 542 - protein, 11 aa, Artificial Sequence
  Description of Artificial Sequence: Synthetic peptide
FYTSPSHPENL

SEQ ID NO: 543 - protein, 11 aa, Artificial Sequence
  Description of Artificial Sequence: Synthetic peptide
FYTSPSHFENL

SEQ ID NO: 544 - protein, 11 aa, Artificial Sequence
  Description of Artificial Sequence: Synthetic peptide
FYTSPSHYENL

SEQ ID NO: 545 - protein, 11 aa, Artificial Sequence
  Description of Artificial Sequence: Synthetic peptide
FYTSPSHWENL

SEQ ID NO: 546 - protein, 11 aa, Artificial Sequence
  Description of Artificial Sequence: Synthetic peptide
FYHSPSMPENL

SEQ ID NO: 547 - protein, 11 aa, Artificial Sequence
  Description of Artificial Sequence: Synthetic peptide
FYHSPSMFENL

SEQ ID NO: 548 - protein, 11 aa, Artificial Sequence
  Description of Artificial Sequence: Synthetic peptide
FYHSPSMYENL

SEQ ID NO: 549 - protein, 11 aa, Artificial Sequence
  Description of Artificial Sequence: Synthetic peptide
FYHSPSMWENL

SEQ ID NO: 550 - protein, 11 aa, Artificial Sequence
  Description of Artificial Sequence: Synthetic peptide
FYHSPSFPENL

SEQ ID NO: 551 - protein, 11 aa, Artificial Sequence
  Description of Artificial Sequence: Synthetic peptide
FYHSPSFFENL

SEQ ID NO: 552 - protein, 11 aa, Artificial Sequence
  Description of Artificial Sequence: Synthetic peptide
FYHSPSFYENL

SEQ ID NO: 553 - protein, 11 aa, Artificial Sequence
  Description of Artificial Sequence: Synthetic peptide
FYHSPSFWENL

SEQ ID NO: 554 - protein, 11 aa, Artificial Sequence
  Description of Artificial Sequence: Synthetic peptide
FYHSPSYPENL

SEQ ID NO: 555 - protein, 11 aa, Artificial Sequence
  Description of Artificial Sequence: Synthetic peptide
FYHSPSYFENL

SEQ ID NO: 556 - protein, 11 aa, Artificial Sequence
  Description of Artificial Sequence: Synthetic peptide
FYHSPSYYENL

SEQ ID NO: 557 - protein, 11 aa, Artificial Sequence
  Description of Artificial Sequence: Synthetic peptide
FYHSPSYWENL

SEQ ID NO: 558 - protein, 11 aa, Artificial Sequence
  Description of Artificial Sequence: Synthetic peptide
FYHSPSDPENL

SEQ ID NO: 559 - protein, 11 aa, Artificial Sequence
  Description of Artificial Sequence: Synthetic peptide
FYHSPSDFENL

SEQ ID NO: 560 - protein, 11 aa, Artificial Sequence
  Description of Artificial Sequence: Synthetic peptide
FYHSPSDYENL

SEQ ID NO: 561 - protein, 11 aa, Artificial Sequence
  Description of Artificial Sequence: Synthetic peptide
FYHSPSDWENL

SEQ ID NO: 562 - protein, 11 aa, Artificial Sequence
  Description of Artificial Sequence: Synthetic peptide
FYHSPSEPENL

SEQ ID NO: 563 - protein, 11 aa, Artificial Sequence
  Description of Artificial Sequence: Synthetic peptide
FYHSPSEFENL

SEQ ID NO: 564 - protein, 11 aa, Artificial Sequence
  Description of Artificial Sequence: Synthetic peptide
FYHSPSEYENL

SEQ ID NO: 565 - protein, 11 aa, Artificial Sequence
  Description of Artificial Sequence: Synthetic peptide
FYHSPSEWENL

SEQ ID NO: 566 - protein, 11 aa, Artificial Sequence
  Description of Artificial Sequence: Synthetic peptide
FYHSPSNPENL

SEQ ID NO: 567 - protein, 11 aa, Artificial Sequence
  Description of Artificial Sequence: Synthetic peptide
FYHSPSNFENL

SEQ ID NO: 568 - protein, 11 aa, Artificial Sequence
  Description of Artificial Sequence: Synthetic peptide
FYHSPSNYENL

SEQ ID NO: 569 - protein, 11 aa, Artificial Sequence
  Description of Artificial Sequence: Synthetic peptide
FYHSPSNWENL

SEQ ID NO: 570 - protein, 11 aa, Artificial Sequence
  Description of Artificial Sequence: Synthetic peptide
FYHSPSQPENL

SEQ ID NO: 571 - protein, 11 aa, Artificial Sequence
  Description of Artificial Sequence: Synthetic peptide
FYHSPSQFENL

SEQ ID NO: 572 - protein, 11 aa, Artificial Sequence
  Description of Artificial Sequence: Synthetic peptide
FYHSPSQYENL

SEQ ID NO: 573 - protein, 11 aa, Artificial Sequence
  Description of Artificial Sequence: Synthetic peptide
FYHSPSQWENL

SEQ ID NO: 574 - protein, 11 aa, Artificial Sequence
  Description of Artificial Sequence: Synthetic peptide
FYHSPSHPENL

SEQ ID NO: 575 - protein, 11 aa, Artificial Sequence
  Description of Artificial Sequence: Synthetic peptide
FYHSPSHFENL

SEQ ID NO: 576 - protein, 11 aa, Artificial Sequence
  Description of Artificial Sequence: Synthetic peptide
FYHSPSHYENL

SEQ ID NO: 577 - protein, 11 aa, Artificial Sequence
  Description of Artificial Sequence: Synthetic peptide
FYHSPSHWENL

SEQ ID NO: 578 - protein, 11 aa, Artificial Sequence
  Description of Artificial Sequence: Synthetic peptide
FYNSPSMPENL

SEQ ID NO: 579 - protein, 11 aa, Artificial Sequence
  Description of Artificial Sequence: Synthetic peptide
FYNSPSMFENL

SEQ ID NO: 580 - protein, 11 aa, Artificial Sequence
  Description of Artificial Sequence: Synthetic peptide
FYNSPSMYENL

SEQ ID NO: 581 - protein, 11 aa, Artificial Sequence
  Description of Artificial Sequence: Synthetic peptide
FYNSPSMWENL

SEQ ID NO: 582 - protein, 11 aa, Artificial Sequence
  Description of Artificial Sequence: Synthetic peptide
FYNSPSFPENL

SEQ ID NO: 583 - protein, 11 aa, Artificial Sequence
  Description of Artificial Sequence: Synthetic peptide
FYNSPSFFENL

SEQ ID NO: 584 - protein, 11 aa, Artificial Sequence
  Description of Artificial Sequence: Synthetic peptide
FYNSPSFYENL

SEQ ID NO: 585 - protein, 11 aa, Artificial Sequence
  Description of Artificial Sequence: Synthetic peptide
FYNSPSFWENL

SEQ ID NO: 586 - protein, 11 aa, Artificial Sequence
  Description of Artificial Sequence: Synthetic peptide
FYNSPSYPENL

SEQ ID NO: 587 - protein, 11 aa, Artificial Sequence
  Description of Artificial Sequence: Synthetic peptide
FYNSPSYFENL

SEQ ID NO: 588 - protein, 11 aa, Artificial Sequence
  Description of Artificial Sequence: Synthetic peptide
FYNSPSYYENL

SEQ ID NO: 589 - protein, 11 aa, Artificial Sequence
  Description of Artificial Sequence: Synthetic peptide
FYNSPSYWENL

SEQ ID NO: 590 - protein, 11 aa, Artificial Sequence
  Description of Artificial Sequence: Synthetic peptide
FYNSPSDPENL

SEQ ID NO: 591 - protein, 11 aa, Artificial Sequence
  Description of Artificial Sequence: Synthetic peptide
FYNSPSDFENL

SEQ ID NO: 592 - protein, 11 aa, Artificial Sequence
  Description of Artificial Sequence: Synthetic peptide
FYNSPSDYENL

SEQ ID NO: 593 - protein, 11 aa, Artificial Sequence
  Description of Artificial Sequence: Synthetic peptide
FYNSPSDWENL

SEQ ID NO: 594 - protein, 11 aa, Artificial Sequence
  Description of Artificial Sequence: Synthetic peptide
FYNSPSEPENL

SEQ ID NO: 595 - protein, 11 aa, Artificial Sequence
  Description of Artificial Sequence: Synthetic peptide
FYNSPSEFENL

SEQ ID NO: 596 - protein, 11 aa, Artificial Sequence
  Description of Artificial Sequence: Synthetic peptide
FYNSPSEYENL

SEQ ID NO: 597 - protein, 11 aa, Artificial Sequence
  Description of Artificial Sequence: Synthetic peptide
FYNSPSEWENL

SEQ ID NO: 598 - protein, 11 aa, Artificial Sequence
  Description of Artificial Sequence: Synthetic peptide
FYNSPSNPENL

SEQ ID NO: 599 - protein, 11 aa, Artificial Sequence
  Description of Artificial Sequence: Synthetic peptide
FYNSPSNFENL

SEQ ID NO: 600 - protein, 11 aa, Artificial Sequence
  Description of Artificial Sequence: Synthetic peptide
FYNSPSNYENL

SEQ ID NO: 601 - protein, 11 aa, Artificial Sequence
  Description of Artificial Sequence: Synthetic peptide
FYNSPSNWENL

SEQ ID NO: 602 - protein, 11 aa, Artificial Sequence
  Description of Artificial Sequence: Synthetic peptide
FYNSPSQPENL

SEQ ID NO: 603 - protein, 11 aa, Artificial Sequence
  Description of Artificial Sequence: Synthetic peptide
FYNSPSQFENL

SEQ ID NO: 604 - protein, 11 aa, Artificial Sequence
  Description of Artificial Sequence: Synthetic peptide
FYNSPSQYENL

SEQ ID NO: 605 - protein, 11 aa, Artificial Sequence
  Description of Artificial Sequence: Synthetic peptide
FYNSPSQWENL

SEQ ID NO: 606 - protein, 11 aa, Artificial Sequence
  Description of Artificial Sequence: Synthetic peptide
FYNSPSHPENL

SEQ ID NO: 607 - protein, 11 aa, Artificial Sequence
  Description of Artificial Sequence: Synthetic peptide
FYNSPSHFENL

SEQ ID NO: 608 - protein, 11 aa, Artificial Sequence
  Description of Artificial Sequence: Synthetic peptide
FYNSPSHYENL

SEQ ID NO: 609 - protein, 11 aa, Artificial Sequence
  Description of Artificial Sequence: Synthetic peptide
FYNSPSHWENL

SEQ ID NO: 610 - protein, 11 aa, Artificial Sequence
  Description of Artificial Sequence: Synthetic peptide
FYGSPSMPENL

SEQ ID NO: 611 - protein, 11 aa, Artificial Sequence
  Description of Artificial Sequence: Synthetic peptide
FYGSPSMFENL

SEQ ID NO: 612 - protein, 11 aa, Artificial Sequence
  Description of Artificial Sequence: Synthetic peptide
FYGSPSMYENL

SEQ ID NO: 613 - protein, 11 aa, Artificial Sequence
  Description of Artificial Sequence: Synthetic peptide
FYGSPSMWENL

SEQ ID NO: 614 - protein, 11 aa, Artificial Sequence
  Description of Artificial Sequence: Synthetic peptide
FYGSPSFPENL

SEQ ID NO: 615 - protein, 11 aa, Artificial Sequence
  Description of Artificial Sequence: Synthetic peptide
FYGSPSFFENL

SEQ ID NO: 616 - protein, 11 aa, Artificial Sequence
  Description of Artificial Sequence: Synthetic peptide
FYGSPSFYENL

SEQ ID NO: 617 - protein, 11 aa, Artificial Sequence
  Description of Artificial Sequence: Synthetic peptide
FYGSPSFWENL

SEQ ID NO: 618 - protein, 11 aa, Artificial Sequence
  Description of Artificial Sequence: Synthetic peptide
FYGSPSYPENL

SEQ ID NO: 619 - protein, 11 aa, Artificial Sequence
  Description of Artificial Sequence: Synthetic peptide
FYGSPSYFENL

SEQ ID NO: 620 - protein, 11 aa, Artificial Sequence
  Description of Artificial Sequence: Synthetic peptide
FYGSPSYYENL

SEQ ID NO: 621 - protein, 11 aa, Artificial Sequence
  Description of Artificial Sequence: Synthetic peptide
FYGSPSYWENL

SEQ ID NO: 622 - protein, 11 aa, Artificial Sequence
  Description of Artificial Sequence: Synthetic peptide
FYGSPSDPENL

SEQ ID NO: 623 - protein, 11 aa, Artificial Sequence
  Description of Artificial Sequence: Synthetic peptide
FYGSPSDFENL

SEQ ID NO: 624 - protein, 11 aa, Artificial Sequence
  Description of Artificial Sequence: Synthetic peptide
FYGSPSDYENL

SEQ ID NO: 625 - protein, 11 aa, Artificial Sequence
  Description of Artificial Sequence: Synthetic peptide
FYGSPSDWENL

SEQ ID NO: 626 - protein, 11 aa, Artificial Sequence
  Description of Artificial Sequence: Synthetic peptide
FYGSPSEPENL

SEQ ID NO: 627 - protein, 11 aa, Artificial Sequence
  Description of Artificial Sequence: Synthetic peptide
FYGSPSEFENL

SEQ ID NO: 628 - protein, 11 aa, Artificial Sequence
  Description of Artificial Sequence: Synthetic peptide
FYGSPSEYENL

SEQ ID NO: 629 - protein, 11 aa, Artificial Sequence
  Description of Artificial Sequence: Synthetic peptide
FYGSPSEWENL

SEQ ID NO: 630 - protein, 11 aa, Artificial Sequence
  Description of Artificial Sequence: Synthetic peptide
FYGSPSNPENL

SEQ ID NO: 631 - protein, 11 aa, Artificial Sequence
  Description of Artificial Sequence: Synthetic peptide
FYGSPSNFENL

SEQ ID NO: 632 - protein, 11 aa, Artificial Sequence
  Description of Artificial Sequence: Synthetic peptide
FYGSPSNYENL

SEQ ID NO: 633 - protein, 11 aa, Artificial Sequence
  Description of Artificial Sequence: Synthetic peptide
FYGSPSNWENL

SEQ ID NO: 634 - protein, 11 aa, Artificial Sequence
  Description of Artificial Sequence: Synthetic peptide
FYGSPSQPENL

SEQ ID NO: 635 - protein, 11 aa, Artificial Sequence
  Description of Artificial Sequence: Synthetic peptide
FYGSPSQFENL

SEQ ID NO: 636 - protein, 11 aa, Artificial Sequence
  Description of Artificial Sequence: Synthetic peptide
FYGSPSQYENL

SEQ ID NO: 637 - protein, 11 aa, Artificial Sequence
  Description of Artificial Sequence: Synthetic peptide
FYGSPSQWENL

SEQ ID NO: 638 - protein, 11 aa, Artificial Sequence
  Description of Artificial Sequence: Synthetic peptide
FYGSPSHPENL

SEQ ID NO: 639 - protein, 11 aa, Artificial Sequence
  Description of Artificial Sequence: Synthetic peptide
FYGSPSHFENL

SEQ ID NO: 640 - protein, 11 aa, Artificial Sequence
  Description of Artificial Sequence: Synthetic peptide
FYGSPSHYENL

SEQ ID NO: 641 - protein, 11 aa, Artificial Sequence
  Description of Artificial Sequence: Synthetic peptide
FYGSPSHWENL

SEQ ID NO: 642 - protein, 11 aa, Artificial Sequence
  Description of Artificial Sequence: Synthetic peptide
FYASPSMPENL

SEQ ID NO: 643 - protein, 11 aa, Artificial Sequence
  Description of Artificial Sequence: Synthetic peptide
FYASPSMFENL

SEQ ID NO: 644 - protein, 11 aa, Artificial Sequence
  Description of Artificial Sequence: Synthetic peptide
FYASPSMYENL

SEQ ID NO: 645 - protein, 11 aa, Artificial Sequence
  Description of Artificial Sequence: Synthetic peptide
FYASPSMWENL

SEQ ID NO: 646 - protein, 11 aa, Artificial Sequence
  Description of Artificial Sequence: Synthetic peptide
FYASPSFPENL

SEQ ID NO: 647 - protein, 11 aa, Artificial Sequence
  Description of Artificial Sequence: Synthetic peptide
FYASPSFFENL

SEQ ID NO: 648 - protein, 11 aa, Artificial Sequence
  Description of Artificial Sequence: Synthetic peptide
FYASPSFYENL

SEQ ID NO: 649 - protein, 11 aa, Artificial Sequence
  Description of Artificial Sequence: Synthetic peptide
FYASPSFWENL

SEQ ID NO: 650 - protein, 11 aa, Artificial Sequence
  Description of Artificial Sequence: Synthetic peptide
FYASPSYPENL

SEQ ID NO: 651 - protein, 11 aa, Artificial Sequence
  Description of Artificial Sequence: Synthetic peptide
FYASPSYFENL

SEQ ID NO: 652 - protein, 11 aa, Artificial Sequence
  Description of Artificial Sequence: Synthetic peptide
FYASPSYYENL

SEQ ID NO: 653 - protein, 11 aa, Artificial Sequence
  Description of Artificial Sequence: Synthetic peptide
FYASPSYWENL

SEQ ID NO: 654 - protein, 11 aa, Artificial Sequence
  Description of Artificial Sequence: Synthetic peptide
FYASPSDPENL

SEQ ID NO: 655 - protein, 11 aa, Artificial Sequence
  Description of Artificial Sequence: Synthetic peptide
FYASPSDFENL

SEQ ID NO: 656 - protein, 11 aa, Artificial Sequence
  Description of Artificial Sequence: Synthetic peptide
FYASPSDYENL

SEQ ID NO: 657 - protein, 11 aa, Artificial Sequence
  Description of Artificial Sequence: Synthetic peptide
FYASPSDWENL

SEQ ID NO: 658 - protein, 11 aa, Artificial Sequence
  Description of Artificial Sequence: Synthetic peptide
FYASPSEPENL

SEQ ID NO: 659 - protein, 11 aa, Artificial Sequence
  Description of Artificial Sequence: Synthetic peptide
FYASPSEFENL

SEQ ID NO: 660 - protein, 11 aa, Artificial Sequence
  Description of Artificial Sequence: Synthetic peptide
FYASPSEYENL

SEQ ID NO: 661 - protein, 11 aa, Artificial Sequence
  Description of Artificial Sequence: Synthetic peptide
FYASPSEWENL

SEQ ID NO: 662 - protein, 11 aa, Artificial Sequence
  Description of Artificial Sequence: Synthetic peptide
FYASPSNPENL

SEQ ID NO: 663 - protein, 11 aa, Artificial Sequence
  Description of Artificial Sequence: Synthetic peptide
FYASPSNFENL

SEQ ID NO: 664 - protein, 11 aa, Artificial Sequence
  Description of Artificial Sequence: Synthetic peptide
FYASPSNYENL

SEQ ID NO: 665 - protein, 11 aa, Artificial Sequence
  Description of Artificial Sequence: Synthetic peptide
FYASPSNWENL

SEQ ID NO: 666 - protein, 11 aa, Artificial Sequence
  Description of Artificial Sequence: Synthetic peptide
FYASPSQPENL

SEQ ID NO: 667 - protein, 11 aa, Artificial Sequence
  Description of Artificial Sequence: Synthetic peptide
FYASPSQFENL

SEQ ID NO: 668 - protein, 11 aa, Artificial Sequence
  Description of Artificial Sequence: Synthetic peptide
FYASPSQYENL

SEQ ID NO: 669 - protein, 11 aa, Artificial Sequence
  Description of Artificial Sequence: Synthetic peptide
FYASPSQWENL

SEQ ID NO: 670 - protein, 11 aa, Artificial Sequence
  Description of Artificial Sequence: Synthetic peptide
FYASPSHPENL

SEQ ID NO: 671 - protein, 11 aa, Artificial Sequence
  Description of Artificial Sequence: Synthetic peptide
FYASPSHFENL

SEQ ID NO: 672 - protein, 11 aa, Artificial Sequence
  Description of Artificial Sequence: Synthetic peptide
FYASPSHYENL

SEQ ID NO: 673 - protein, 11 aa, Artificial Sequence
  Description of Artificial Sequence: Synthetic peptide
FYASPSHWENL

SEQ ID NO: 674 - protein, 11 aa, Artificial Sequence
  Description of Artificial Sequence: Synthetic peptide
FFRSPSMPENL

SEQ ID NO: 675 - protein, 11 aa, Artificial Sequence
  Description of Artificial Sequence: Synthetic peptide
FFRSPSMFENL

SEQ ID NO: 676 - protein, 11 aa, Artificial Sequence
  Description of Artificial Sequence: Synthetic peptide
FFRSPSMYENL

SEQ ID NO: 677 - protein, 11 aa, Artificial Sequence
  Description of Artificial Sequence: Synthetic peptide
FFRSPSMWENL

SEQ ID NO: 678 - protein, 11 aa, Artificial Sequence
  Description of Artificial Sequence: Synthetic peptide
FFRSPSFPENL

SEQ ID NO: 679 - protein, 11 aa, Artificial Sequence
  Description of Artificial Sequence: Synthetic peptide
FFRSPSFFENL

SEQ ID NO: 680 - protein, 11 aa, Artificial Sequence
  Description of Artificial Sequence: Synthetic peptide
FFRSPSFYENL

SEQ ID NO: 681 - protein, 11 aa, Artificial Sequence
  Description of Artificial Sequence: Synthetic peptide
FFRSPSFWENL

SEQ ID NO: 682 - protein, 11 aa, Artificial Sequence
  Description of Artificial Sequence: Synthetic peptide
FFRSPSYPENL

SEQ ID NO: 683 - protein, 11 aa, Artificial Sequence
  Description of Artificial Sequence: Synthetic peptide
FFRSPSYFENL

SEQ ID NO: 684 - protein, 11 aa, Artificial Sequence
  Description of Artificial Sequence: Synthetic peptide
FFRSPSYYENL

SEQ ID NO: 685 - protein, 11 aa, Artificial Sequence
  Description of Artificial Sequence: Synthetic peptide
FFRSPSYWENL

SEQ ID NO: 686 - protein, 11 aa, Artificial Sequence
  Description of Artificial Sequence: Synthetic peptide
FFRSPSDPENL

SEQ ID NO: 687 - protein, 11 aa, Artificial Sequence
  Description of Artificial Sequence: Synthetic peptide
FFRSPSDFENL

SEQ ID NO: 688 - protein, 11 aa, Artificial Sequence
  Description of Artificial Sequence: Synthetic peptide
FFRSPSDYENL

SEQ ID NO: 689 - protein, 11 aa, Artificial Sequence
  Description of Artificial Sequence: Synthetic peptide
FFRSPSDWENL

SEQ ID NO: 690 - protein, 11 aa, Artificial Sequence
  Description of Artificial Sequence: Synthetic peptide
FFRSPSEPENL

SEQ ID NO: 691 - protein, 11 aa, Artificial Sequence
  Description of Artificial Sequence: Synthetic peptide
FFRSPSEFENL

SEQ ID NO: 692 - protein, 11 aa, Artificial Sequence
  Description of Artificial Sequence: Synthetic peptide
FFRSPSEYENL

SEQ ID NO: 693 - protein, 11 aa, Artificial Sequence
  Description of Artificial Sequence: Synthetic peptide
FFRSPSEWENL

SEQ ID NO: 694 - protein, 11 aa, Artificial Sequence
  Description of Artificial Sequence: Synthetic peptide
FFRSPSNPENL

SEQ ID NO: 695 - protein, 11 aa, Artificial Sequence
  Description of Artificial Sequence: Synthetic peptide
FFRSPSNFENL

SEQ ID NO: 696 - protein, 11 aa, Artificial Sequence
  Description of Artificial Sequence: Synthetic peptide
FFRSPSNYENL

SEQ ID NO: 697 - protein, 11 aa, Artificial Sequence
  Description of Artificial Sequence: Synthetic peptide
FFRSPSNWENL

SEQ ID NO: 698 - protein, 11 aa, Artificial Sequence
  Description of Artificial Sequence: Synthetic peptide
FFRSPSQPENL

SEQ ID NO: 699 - protein, 11 aa, Artificial Sequence
  Description of Artificial Sequence: Synthetic peptide
FFRSPSQFENL

SEQ ID NO: 700 - protein, 11 aa, Artificial Sequence
  Description of Artificial Sequence: Synthetic peptide
FFRSPSQYENL

SEQ ID NO: 701 - protein, 11 aa, Artificial Sequence
  Description of Artificial Sequence: Synthetic peptide
FFRSPSQWENL

SEQ ID NO: 702 - protein, 11 aa, Artificial Sequence
  Description of Artificial Sequence: Synthetic peptide
FFRSPSHPENL

SEQ ID NO: 703 - protein, 11 aa, Artificial Sequence
  Description of Artificial Sequence: Synthetic peptide
FFRSPSHFENL

SEQ ID NO: 704 - protein, 11 aa, Artificial Sequence
  Description of Artificial Sequence: Synthetic peptide
FFRSPSHYENL

SEQ ID NO: 705 - protein, 11 aa, Artificial Sequence
  Description of Artificial Sequence: Synthetic peptide
FFRSPSHWENL

SEQ ID NO: 706 - protein, 11 aa, Artificial Sequence
  Description of Artificial Sequence: Synthetic peptide
FFSSPSMPENL

SEQ ID NO: 707 - protein, 11 aa, Artificial Sequence
  Description of Artificial Sequence: Synthetic peptide
FFSSPSMFENL

SEQ ID NO: 708 - protein, 11 aa, Artificial Sequence
  Description of Artificial Sequence: Synthetic peptide
FFSSPSMYENL

SEQ ID NO: 709 - protein, 11 aa, Artificial Sequence
  Description of Artificial Sequence: Synthetic peptide
FFSSPSMWENL

SEQ ID NO: 710 - protein, 11 aa, Artificial Sequence
  Description of Artificial Sequence: Synthetic peptide
FFSSPSFPENL

SEQ ID NO: 711 - protein, 11 aa, Artificial Sequence
  Description of Artificial Sequence: Synthetic peptide
FFSSPSFFENL

SEQ ID NO: 712 - protein, 11 aa, Artificial Sequence
  Description of Artificial Sequence: Synthetic peptide
FFSSPSFYENL

SEQ ID NO: 713 - protein, 11 aa, Artificial Sequence
  Description of Artificial Sequence: Synthetic peptide
FFSSPSFWENL

SEQ ID NO: 714 - protein, 11 aa, Artificial Sequence
  Description of Artificial Sequence: Synthetic peptide
FFSSPSYPENL

SEQ ID NO: 715 - protein, 11 aa, Artificial Sequence
  Description of Artificial Sequence: Synthetic peptide
FFSSPSYFENL

SEQ ID NO: 716 - protein, 11 aa, Artificial Sequence
  Description of Artificial Sequence: Synthetic peptide
FFSSPSYYENL

SEQ ID NO: 717 - protein, 11 aa, Artificial Sequence
  Description of Artificial Sequence: Synthetic peptide
FFSSPSYWENL

SEQ ID NO: 718 - protein, 11 aa, Artificial Sequence
  Description of Artificial Sequence: Synthetic peptide
FFSSPSDPENL

SEQ ID NO: 719 - protein, 11 aa, Artificial Sequence
  Description of Artificial Sequence: Synthetic peptide
FFSSPSDFENL

SEQ ID NO: 720 - protein, 11 aa, Artificial Sequence
  Description of Artificial Sequence: Synthetic peptide
FFSSPSDYENL

SEQ ID NO: 721 - protein, 11 aa, Artificial Sequence
  Description of Artificial Sequence: Synthetic peptide
FFSSPSDWENL

SEQ ID NO: 722 - protein, 11 aa, Artificial Sequence
  Description of Artificial Sequence: Synthetic peptide
FFSSPSEPENL

SEQ ID NO: 723 - protein, 11 aa, Artificial Sequence
  Description of Artificial Sequence: Synthetic peptide
FFSSPSEFENL

SEQ ID NO: 724 - protein, 11 aa, Artificial Sequence
  Description of Artificial Sequence: Synthetic peptide
FFSSPSEYENL

SEQ ID NO: 725 - protein, 11 aa, Artificial Sequence
  Description of Artificial Sequence: Synthetic peptide
FFSSPSEWENL

SEQ ID NO: 726 - protein, 11 aa, Artificial Sequence
  Description of Artificial Sequence: Synthetic peptide
FFSSPSNPENL

SEQ ID NO: 727 - protein, 11 aa, Artificial Sequence
  Description of Artificial Sequence: Synthetic peptide
FFSSPSNFENL

SEQ ID NO: 728 - protein, 11 aa, Artificial Sequence
  Description of Artificial Sequence: Synthetic peptide
FFSSPSNYENL

SEQ ID NO: 729 - protein, 11 aa, Artificial Sequence
  Description of Artificial Sequence: Synthetic peptide
FFSSPSNWENL

SEQ ID NO: 730 - protein, 11 aa, Artificial Sequence
  Description of Artificial Sequence: Synthetic peptide
FFSSPSQPENL

SEQ ID NO: 731 - protein, 11 aa, Artificial Sequence
  Description of Artificial Sequence: Synthetic peptide
FFSSPSQFENL

SEQ ID NO: 732 - protein, 11 aa, Artificial Sequence
  Description of Artificial Sequence: Synthetic peptide
FFSSPSQYENL

SEQ ID NO: 733 - protein, 11 aa, Artificial Sequence
  Description of Artificial Sequence: Synthetic peptide
FFSSPSQWENL

SEQ ID NO: 734 - protein, 11 aa, Artificial Sequence
  Description of Artificial Sequence: Synthetic peptide
FFSSPSHPENL

SEQ ID NO: 735 - protein, 11 aa, Artificial Sequence
  Description of Artificial Sequence: Synthetic peptide
FFSSPSHFENL

SEQ ID NO: 736 - protein, 11 aa, Artificial Sequence
  Description of Artificial Sequence: Synthetic peptide
FFSSPSHYENL

SEQ ID NO: 737 - protein, 11 aa, Artificial Sequence
  Description of Artificial Sequence: Synthetic peptide
FFSSPSHWENL

SEQ ID NO: 738 - protein, 11 aa, Artificial Sequence
  Description of Artificial Sequence: Synthetic peptide
FFTSPSMPENL

SEQ ID NO: 739 - protein, 11 aa, Artificial Sequence
  Description of Artificial Sequence: Synthetic peptide
FFTSPSMFENL

SEQ ID NO: 740 - protein, 11 aa, Artificial Sequence
  Description of Artificial Sequence: Synthetic peptide
FFTSPSMYENL

SEQ ID NO: 741 - protein, 11 aa, Artificial Sequence
  Description of Artificial Sequence: Synthetic peptide
FFTSPSMWENL

SEQ ID NO: 742 - protein, 11 aa, Artificial Sequence
  Description of Artificial Sequence: Synthetic peptide
FFTSPSFPENL

SEQ ID NO: 743 - protein, 11 aa, Artificial Sequence
  Description of Artificial Sequence: Synthetic peptide
FFTSPSFFENL

SEQ ID NO: 744 - protein, 11 aa, Artificial Sequence
  Description of Artificial Sequence: Synthetic peptide
FFTSPSFYENL

SEQ ID NO: 745 - protein, 11 aa, Artificial Sequence
  Description of Artificial Sequence: Synthetic peptide
FFTSPSFWENL

SEQ ID NO: 746 - protein, 11 aa, Artificial Sequence
  Description of Artificial Sequence: Synthetic peptide
FFTSPSYPENL

SEQ ID NO: 747 - protein, 11 aa, Artificial Sequence
  Description of Artificial Sequence: Synthetic peptide
FFTSPSYFENL

SEQ ID NO: 748 - protein, 11 aa, Artificial Sequence
  Description of Artificial Sequence: Synthetic peptide
FFTSPSYYENL

SEQ ID NO: 749 - protein, 11 aa, Artificial Sequence
  Description of Artificial Sequence: Synthetic peptide
FFTSPSYWENL

SEQ ID NO: 750 - protein, 11 aa, Artificial Sequence
  Description of Artificial Sequence: Synthetic peptide
FFTSPSDPENL

SEQ ID NO: 751 - protein, 11 aa, Artificial Sequence
  Description of Artificial Sequence: Synthetic peptide
FFTSPSDFENL

SEQ ID NO: 752 - protein, 11 aa, Artificial Sequence
  Description of Artificial Sequence: Synthetic peptide
FFTSPSDYENL

SEQ ID NO: 753 - protein, 11 aa, Artificial Sequence
  Description of Artificial Sequence: Synthetic peptide
FFTSPSDWENL

SEQ ID NO: 754 - protein, 11 aa, Artificial Sequence
  Description of Artificial Sequence: Synthetic peptide
FFTSPSEPENL

SEQ ID NO: 755 - protein, 11 aa, Artificial Sequence
  Description of Artificial Sequence: Synthetic peptide
FFTSPSEFENL

SEQ ID NO: 756 - protein, 11 aa, Artificial Sequence
  Description of Artificial Sequence: Synthetic peptide
FFTSPSEYENL

SEQ ID NO: 757 - protein, 11 aa, Artificial Sequence
  Description of Artificial Sequence: Synthetic peptide
FFTSPSEWENL

SEQ ID NO: 758 - protein, 11 aa, Artificial Sequence
  Description of Artificial Sequence: Synthetic peptide
FFTSPSNPENL

SEQ ID NO: 759 - protein, 11 aa, Artificial Sequence
  Description of Artificial Sequence: Synthetic peptide
FFTSPSNFENL

SEQ ID NO: 760 - protein, 11 aa, Artificial Sequence
  Description of Artificial Sequence: Synthetic peptide
FFTSPSNYENL

SEQ ID NO: 761 - protein, 11 aa, Artificial Sequence
  Description of Artificial Sequence: Synthetic peptide
FFTSPSNWENL

SEQ ID NO: 762 - protein, 11 aa, Artificial Sequence
  Description of Artificial Sequence: Synthetic peptide
FFTSPSQPENL

SEQ ID NO: 763 - protein, 11 aa, Artificial Sequence
  Description of Artificial Sequence: Synthetic peptide
FFTSPSQFENL

SEQ ID NO: 764 - protein, 11 aa, Artificial Sequence
  Description of Artificial Sequence: Synthetic peptide
FFTSPSQYENL

SEQ ID NO: 765 - protein, 11 aa, Artificial Sequence
  Description of Artificial Sequence: Synthetic peptide
FFTSPSQWENL

SEQ ID NO: 766 - protein, 11 aa, Artificial Sequence
  Description of Artificial Sequence: Synthetic peptide
FFTSPSHPENL

SEQ ID NO: 767 - protein, 11 aa, Artificial Sequence
  Description of Artificial Sequence: Synthetic peptide
FFTSPSHFENL

SEQ ID NO: 768 - protein, 11 aa, Artificial Sequence
  Description of Artificial Sequence: Synthetic peptide
FFTSPSHYENL

SEQ ID NO: 769 - protein, 11 aa, Artificial Sequence
  Description of Artificial Sequence: Synthetic peptide
FFTSPSHWENL

SEQ ID NO: 770 - protein, 11 aa, Artificial Sequence
  Description of Artificial Sequence: Synthetic peptide
FFHSPSMPENL

SEQ ID NO: 771 - protein, 11 aa, Artificial Sequence
  Description of Artificial Sequence: Synthetic peptide
FFHSPSMFENL

SEQ ID NO: 772 - protein, 11 aa, Artificial Sequence
  Description of Artificial Sequence: Synthetic peptide
FFHSPSMYENL

SEQ ID NO: 773 - protein, 11 aa, Artificial Sequence
  Description of Artificial Sequence: Synthetic peptide
FFHSPSMWENL

SEQ ID NO: 774 - protein, 11 aa, Artificial Sequence
  Description of Artificial Sequence: Synthetic peptide
FFHSPSFPENL

SEQ ID NO: 775 - protein, 11 aa, Artificial Sequence
  Description of Artificial Sequence: Synthetic peptide
FFHSPSFFENL

SEQ ID NO: 776 - protein, 11 aa, Artificial Sequence
  Description of Artificial Sequence: Synthetic peptide
FFHSPSFYENL

SEQ ID NO: 777 - protein, 11 aa, Artificial Sequence
  Description of Artificial Sequence: Synthetic peptide
FFHSPSFWENL

SEQ ID NO: 778 - protein, 11 aa, Artificial Sequence
  Description of Artificial Sequence: Synthetic peptide
FFHSPSYPENL

SEQ ID NO: 779 - protein, 11 aa, Artificial Sequence
  Description of Artificial Sequence: Synthetic peptide
FFHSPSYFENL

SEQ ID NO: 780 - protein, 11 aa, Artificial Sequence
  Description of Artificial Sequence: Synthetic peptide
FFHSPSYYENL

SEQ ID NO: 781 - protein, 11 aa, Artificial Sequence
  Description of Artificial Sequence: Synthetic peptide
FFHSPSYWENL

SEQ ID NO: 782 - protein, 11 aa, Artificial Sequence
  Description of Artificial Sequence: Synthetic peptide
FFHSPSDPENL

SEQ ID NO: 783 - protein, 11 aa, Artificial Sequence
  Description of Artificial Sequence: Synthetic peptide
FFHSPSDFENL

SEQ ID NO: 784 - protein, 11 aa, Artificial Sequence
  Description of Artificial Sequence: Synthetic peptide
FFHSPSDYENL

SEQ ID NO: 785 - protein, 11 aa, Artificial Sequence
  Description of Artificial Sequence: Synthetic peptide
FFHSPSDWENL

SEQ ID NO: 786 - protein, 11 aa, Artificial Sequence
  Description of Artificial Sequence: Synthetic peptide
FFHSPSEPENL

SEQ ID NO: 787 - protein, 11 aa, Artificial Sequence
  Description of Artificial Sequence: Synthetic peptide
FFHSPSEFENL

SEQ ID NO: 788 - protein, 11 aa, Artificial Sequence
  Description of Artificial Sequence: Synthetic peptide
FFHSPSEYENL

SEQ ID NO: 789 - protein, 11 aa, Artificial Sequence
  Description of Artificial Sequence: Synthetic peptide
FFHSPSEWENL

SEQ ID NO: 790 - protein, 11 aa, Artificial Sequence
  Description of Artificial Sequence: Synthetic peptide
FFHSPSNPENL

SEQ ID NO: 791 - protein, 11 aa, Artificial Sequence
  Description of Artificial Sequence: Synthetic peptide
FFHSPSNFENL

SEQ ID NO: 792 - protein, 11 aa, Artificial Sequence
  Description of Artificial Sequence: Synthetic peptide
FFHSPSNYENL

SEQ ID NO: 793 - protein, 11 aa, Artificial Sequence
  Description of Artificial Sequence: Synthetic peptide
FFHSPSNWENL

SEQ ID NO: 794 - protein, 11 aa, Artificial Sequence
  Description of Artificial Sequence: Synthetic peptide
FFHSPSQPENL

SEQ ID NO: 795 - protein, 11 aa, Artificial Sequence
  Description of Artificial Sequence: Synthetic peptide
FFHSPSQFENL

SEQ ID NO: 796 - protein, 11 aa, Artificial Sequence
  Description of Artificial Sequence: Synthetic peptide
FFHSPSQYENL

SEQ ID NO: 797 - protein, 11 aa, Artificial Sequence
  Description of Artificial Sequence: Synthetic peptide
FFHSPSQWENL

SEQ ID NO: 798 - protein, 11 aa, Artificial Sequence
  Description of Artificial Sequence: Synthetic peptide
FFHSPSHPENL

SEQ ID NO: 799 - protein, 11 aa, Artificial Sequence
  Description of Artificial Sequence: Synthetic peptide
FFHSPSHFENL

SEQ ID NO: 800 - protein, 11 aa, Artificial Sequence
  Description of Artificial Sequence: Synthetic peptide
FFHSPSHYENL

SEQ ID NO: 801 - protein, 11 aa, Artificial Sequence
  Description of Artificial Sequence: Synthetic peptide
FFHSPSHWENL

SEQ ID NO: 802 - protein, 11 aa, Artificial Sequence
  Description of Artificial Sequence: Synthetic peptide
FFNSPSMPENL

SEQ ID NO: 803 - protein, 11 aa, Artificial Sequence
  Description of Artificial Sequence: Synthetic peptide
FFNSPSMFENL

SEQ ID NO: 804 - protein, 11 aa, Artificial Sequence
  Description of Artificial Sequence: Synthetic peptide
FFNSPSMYENL

SEQ ID NO: 805 - protein, 11 aa, Artificial Sequence
  Description of Artificial Sequence: Synthetic peptide
FFNSPSMWENL

SEQ ID NO: 806 - protein, 11 aa, Artificial Sequence
  Description of Artificial Sequence: Synthetic peptide
FFNSPSFPENL

SEQ ID NO: 807 - protein, 11 aa, Artificial Sequence
  Description of Artificial Sequence: Synthetic peptide
FFNSPSFFENL

SEQ ID NO: 808 - protein, 11 aa, Artificial Sequence
  Description of Artificial Sequence: Synthetic peptide
FFNSPSFYENL

SEQ ID NO: 809 - protein, 11 aa, Artificial Sequence
  Description of Artificial Sequence: Synthetic peptide
FFNSPSFWENL

SEQ ID NO: 810 - protein, 11 aa, Artificial Sequence
  Description of Artificial Sequence: Synthetic peptide
FFNSPSYPENL

SEQ ID NO: 811 - protein, 11 aa, Artificial Sequence
  Description of Artificial Sequence: Synthetic peptide
FFNSPSYFENL

SEQ ID NO: 812 - protein, 11 aa, Artificial Sequence
  Description of Artificial Sequence: Synthetic peptide
FFNSPSYYENL

SEQ ID NO: 813 - protein, 11 aa, Artificial Sequence
  Description of Artificial Sequence: Synthetic peptide
FFNSPSYWENL

SEQ ID NO: 814 - protein, 11 aa, Artificial Sequence
  Description of Artificial Sequence: Synthetic peptide
FFNSPSDPENL

SEQ ID NO: 815 - protein, 11 aa, Artificial Sequence
  Description of Artificial Sequence: Synthetic peptide
FFNSPSDFENL

SEQ ID NO: 816 - protein, 11 aa, Artificial Sequence
  Description of Artificial Sequence: Synthetic peptide
FFNSPSDYENL

SEQ ID NO: 817 - protein, 11 aa, Artificial Sequence
  Description of Artificial Sequence: Synthetic peptide
FFNSPSDWENL

SEQ ID NO: 818 - protein, 11 aa, Artificial Sequence
  Description of Artificial Sequence: Synthetic peptide
FFNSPSEPENL

SEQ ID NO: 819 - protein, 11 aa, Artificial Sequence
  Description of Artificial Sequence: Synthetic peptide
FFNSPSEFENL

SEQ ID NO: 820 - protein, 11 aa, Artificial Sequence
  Description of Artificial Sequence: Synthetic peptide
FFNSPSEYENL

SEQ ID NO: 821 - protein, 11 aa, Artificial Sequence
  Description of Artificial Sequence: Synthetic peptide
FFNSPSEWENL

SEQ ID NO: 822 - protein, 11 aa, Artificial Sequence
  Description of Artificial Sequence: Synthetic peptide
FFNSPSNPENL

SEQ ID NO: 823 - protein, 11 aa, Artificial Sequence
  Description of Artificial Sequence: Synthetic peptide
FFNSPSNFENL

SEQ ID NO: 824 - protein, 11 aa, Artificial Sequence
  Description of Artificial Sequence: Synthetic peptide
FFNSPSNYENL

SEQ ID NO: 825 - protein, 11 aa, Artificial Sequence
  Description of Artificial Sequence: Synthetic peptide
FFNSPSNWENL

SEQ ID NO: 826 - protein, 11 aa, Artificial Sequence
  Description of Artificial Sequence: Synthetic peptide
FFNSPSQPENL

SEQ ID NO: 827 - protein, 11 aa, Artificial Sequence
  Description of Artificial Sequence: Synthetic peptide
FFNSPSQFENL

SEQ ID NO: 828 - protein, 11 aa, Artificial Sequence
  Description of Artificial Sequence: Synthetic peptide
FFNSPSQYENL

SEQ ID NO: 829 - protein, 11 aa, Artificial Sequence
  Description of Artificial Sequence: Synthetic peptide
FFNSPSQWENL

SEQ ID NO: 830 - protein, 11 aa, Artificial Sequence
  Description of Artificial Sequence: Synthetic peptide
FFNSPSHPENL

SEQ ID NO: 831 - protein, 11 aa, Artificial Sequence
  Description of Artificial Sequence: Synthetic peptide
FFNSPSHFENL

SEQ ID NO: 832 - protein, 11 aa, Artificial Sequence
  Description of Artificial Sequence: Synthetic peptide
FFNSPSHYENL

SEQ ID NO: 833 - protein, 11 aa, Artificial Sequence
  Description of Artificial Sequence: Synthetic peptide
FFNSPSHWENL

SEQ ID NO: 834 - protein, 11 aa, Artificial Sequence
  Description of Artificial Sequence: Synthetic peptide
FFGSPSMPENL

SEQ ID NO: 835 - protein, 11 aa, Artificial Sequence
  Description of Artificial Sequence: Synthetic peptide
FFGSPSMFENL

SEQ ID NO: 836 - protein, 11 aa, Artificial Sequence
  Description of Artificial Sequence: Synthetic peptide
FFGSPSMYENL

SEQ ID NO: 837 - protein, 11 aa, Artificial Sequence
  Description of Artificial Sequence: Synthetic peptide
FFGSPSMWENL

SEQ ID NO: 838 - protein, 11 aa, Artificial Sequence
  Description of Artificial Sequence: Synthetic peptide
FFGSPSFPENL

SEQ ID NO: 839 - protein, 11 aa, Artificial Sequence
  Description of Artificial Sequence: Synthetic peptide
FFGSPSFFENL

SEQ ID NO: 840 - protein, 11 aa, Artificial Sequence
  Description of Artificial Sequence: Synthetic peptide
FFGSPSFYENL

SEQ ID NO: 841 - protein, 11 aa, Artificial Sequence
  Description of Artificial Sequence: Synthetic peptide
FFGSPSFWENL

SEQ ID NO: 842 - protein, 11 aa, Artificial Sequence
  Description of Artificial Sequence: Synthetic peptide
FFGSPSYPENL

SEQ ID NO: 843 - protein, 11 aa, Artificial Sequence
  Description of Artificial Sequence: Synthetic peptide
FFGSPSYFENL

SEQ ID NO: 844 - protein, 11 aa, Artificial Sequence
  Description of Artificial Sequence: Synthetic peptide
FFGSPSYYENL

SEQ ID NO: 845 - protein, 11 aa, Artificial Sequence
  Description of Artificial Sequence: Synthetic peptide
FFGSPSYWENL

SEQ ID NO: 846 - protein, 11 aa, Artificial Sequence
  Description of Artificial Sequence: Synthetic peptide
FFGSPSDPENL

SEQ ID NO: 847 - protein, 11 aa, Artificial Sequence
  Description of Artificial Sequence: Synthetic peptide
FFGSPSDFENL

SEQ ID NO: 848 - protein, 11 aa, Artificial Sequence
  Description of Artificial Sequence: Synthetic peptide
FFGSPSDYENL

SEQ ID NO: 849 - protein, 11 aa, Artificial Sequence
  Description of Artificial Sequence: Synthetic peptide
FFGSPSDWENL

SEQ ID NO: 850 - protein, 11 aa, Artificial Sequence
  Description of Artificial Sequence: Synthetic peptide
FFGSPSEPENL

SEQ ID NO: 851 - protein, 11 aa, Artificial Sequence
  Description of Artificial Sequence: Synthetic peptide
FFGSPSEFENL

SEQ ID NO: 852 - protein, 11 aa, Artificial Sequence
  Description of Artificial Sequence: Synthetic peptide
FFGSPSEYENL

SEQ ID NO: 853 - protein, 11 aa, Artificial Sequence
  Description of Artificial Sequence: Synthetic peptide
FFGSPSEWENL

SEQ ID NO: 854 - protein, 11 aa, Artificial Sequence
  Description of Artificial Sequence: Synthetic peptide
FFGSPSNPENL

SEQ ID NO: 855 - protein, 11 aa, Artificial Sequence
  Description of Artificial Sequence: Synthetic peptide
FFGSPSNFENL

SEQ ID NO: 856 - protein, 11 aa, Artificial Sequence
  Description of Artificial Sequence: Synthetic peptide
FFGSPSNYENL

SEQ ID NO: 857 - protein, 11 aa, Artificial Sequence
  Description of Artificial Sequence: Synthetic peptide
FFGSPSNWENL

SEQ ID NO: 858 - protein, 11 aa, Artificial Sequence
  Description of Artificial Sequence: Synthetic peptide
FFGSPSQPENL

SEQ ID NO: 859 - protein, 11 aa, Artificial Sequence
  Description of Artificial Sequence: Synthetic peptide
FFGSPSQFENL

SEQ ID NO: 860 - protein, 11 aa, Artificial Sequence
  Description of Artificial Sequence: Synthetic peptide
FFGSPSQYENL

SEQ ID NO: 861 - protein, 11 aa, Artificial Sequence
  Description of Artificial Sequence: Synthetic peptide
FFGSPSQWENL

SEQ ID NO: 862 - protein, 11 aa, Artificial Sequence
  Description of Artificial Sequence: Synthetic peptide
FFGSPSHPENL

SEQ ID NO: 863 - protein, 11 aa, Artificial Sequence
  Description of Artificial Sequence: Synthetic peptide
FFGSPSHFENL

SEQ ID NO: 864 - protein, 11 aa, Artificial Sequence
  Description of Artificial Sequence: Synthetic peptide
FFGSPSHYENL

SEQ ID NO: 865 - protein, 11 aa, Artificial Sequence
  Description of Artificial Sequence: Synthetic peptide
FFGSPSHWENL

SEQ ID NO: 866 - protein, 11 aa, Artificial Sequence
  Description of Artificial Sequence: Synthetic peptide
FFASPSMPENL

SEQ ID NO: 867 - protein, 11 aa, Artificial Sequence
  Description of Artificial Sequence: Synthetic peptide
FFASPSMFENL

SEQ ID NO: 868 - protein, 11 aa, Artificial Sequence
  Description of Artificial Sequence: Synthetic peptide
FFASPSMYENL

SEQ ID NO: 869 - protein, 11 aa, Artificial Sequence
  Description of Artificial Sequence: Synthetic peptide
FFASPSMWENL

SEQ ID NO: 870 - protein, 11 aa, Artificial Sequence
  Description of Artificial Sequence: Synthetic peptide
FFASPSFPENL

SEQ ID NO: 871 - protein, 11 aa, Artificial Sequence
  Description of Artificial Sequence: Synthetic peptide
FFASPSFFENL

SEQ ID NO: 872 - protein, 11 aa, Artificial Sequence
  Description of Artificial Sequence: Synthetic peptide
FFASPSFYENL

SEQ ID NO: 873 - protein, 11 aa, Artificial Sequence
  Description of Artificial Sequence: Synthetic peptide
FFASPSFWENL

SEQ ID NO: 874 - protein, 11 aa, Artificial Sequence
  Description of Artificial Sequence: Synthetic peptide
FFASPSYPENL

SEQ ID NO: 875 - protein, 11 aa, Artificial Sequence
  Description of Artificial Sequence: Synthetic peptide
FFASPSYFENL

SEQ ID NO: 876 - protein, 11 aa, Artificial Sequence
  Description of Artificial Sequence: Synthetic peptide
FFASPSYYENL

SEQ ID NO: 877 - protein, 11 aa, Artificial Sequence
  Description of Artificial Sequence: Synthetic peptide
FFASPSYWENL

SEQ ID NO: 878 - protein, 11 aa, Artificial Sequence
  Description of Artificial Sequence: Synthetic peptide
FFASPSDPENL

SEQ ID NO: 879 - protein, 11 aa, Artificial Sequence
  Description of Artificial Sequence: Synthetic peptide
FFASPSDFENL

SEQ ID NO: 880 - protein, 11 aa, Artificial Sequence
  Description of Artificial Sequence: Synthetic peptide
FFASPSDYENL

SEQ ID NO: 881 - protein, 11 aa, Artificial Sequence
  Description of Artificial Sequence: Synthetic peptide
FFASPSDWENL

SEQ ID NO: 882 - protein, 11 aa, Artificial Sequence
  Description of Artificial Sequence: Synthetic peptide
FFASPSEPENL

SEQ ID NO: 883 - protein, 11 aa, Artificial Sequence
  Description of Artificial Sequence: Synthetic peptide
FFASPSEFENL

SEQ ID NO: 884 - protein, 11 aa, Artificial Sequence
  Description of Artificial Sequence: Synthetic peptide
FFASPSEYENL

SEQ ID NO: 885 - protein, 11 aa, Artificial Sequence
  Description of Artificial Sequence: Synthetic peptide
FFASPSEWENL

SEQ ID NO: 886 - protein, 11 aa, Artificial Sequence
  Description of Artificial Sequence: Synthetic peptide
FFASPSNPENL

SEQ ID NO: 887 - protein, 11 aa, Artificial Sequence
  Description of Artificial Sequence: Synthetic peptide
FFASPSNFENL

SEQ ID NO: 888 - protein, 11 aa, Artificial Sequence
  Description of Artificial Sequence: Synthetic peptide
FFASPSNYENL

SEQ ID NO: 889 - protein, 11 aa, Artificial Sequence
  Description of Artificial Sequence: Synthetic peptide
FFASPSNWENL

SEQ ID NO: 890 - protein, 11 aa, Artificial Sequence
  Description of Artificial Sequence: Synthetic peptide
FFASPSQPENL

SEQ ID NO: 891 - protein, 11 aa, Artificial Sequence
  Description of Artificial Sequence: Synthetic peptide
FFASPSQFENL

SEQ ID NO: 892 - protein, 11 aa, Artificial Sequence
  Description of Artificial Sequence: Synthetic peptide
FFASPSQYENL

SEQ ID NO: 893 - protein, 11 aa, Artificial Sequence
  Description of Artificial Sequence: Synthetic peptide
FFASPSQWENL

SEQ ID NO: 894 - protein, 11 aa, Artificial Sequence
  Description of Artificial Sequence: Synthetic peptide
FFASPSHPENL

SEQ ID NO: 895 - protein, 11 aa, Artificial Sequence
  Description of Artificial Sequence: Synthetic peptide
FFASPSHFENL

SEQ ID NO: 896 - protein, 11 aa, Artificial Sequence
  Description of Artificial Sequence: Synthetic peptide
FFASPSHYENL

SEQ ID NO: 897 - protein, 11 aa, Artificial Sequence
  Description of Artificial Sequence: Synthetic peptide
FFASPSHWENL

SEQ ID NO: 898 - protein, 11 aa, Artificial Sequence
  Description of Artificial Sequence: Synthetic peptide
WYRSPSMPENL

SEQ ID NO: 899 - protein, 11 aa, Artificial Sequence
  Description of Artificial Sequence: Synthetic peptide
WYRSPSMFENL

SEQ ID NO: 900 - protein, 11 aa, Artificial Sequence
  Description of Artificial Sequence: Synthetic peptide
WYRSPSMYENL

SEQ ID NO: 901 - protein, 11 aa, Artificial Sequence
  Description of Artificial Sequence: Synthetic peptide
WYRSPSMWENL

SEQ ID NO: 902 - protein, 11 aa, Artificial Sequence
  Description of Artificial Sequence: Synthetic peptide
WYRSPSFPENL

SEQ ID NO: 903 - protein, 11 aa, Artificial Sequence
  Description of Artificial Sequence: Synthetic peptide
WYRSPSFFENL

SEQ ID NO: 904 - protein, 11 aa, Artificial Sequence
  Description of Artificial Sequence: Synthetic peptide
WYRSPSFYENL

SEQ ID NO: 905 - protein, 11 aa, Artificial Sequence
  Description of Artificial Sequence: Synthetic peptide
WYRSPSFWENL

SEQ ID NO: 906 - protein, 11 aa, Artificial Sequence
  Description of Artificial Sequence: Synthetic peptide
WYRSPSYPENL

SEQ ID NO: 907 - protein, 11 aa, Artificial Sequence
  Description of Artificial Sequence: Synthetic peptide
WYRSPSYFENL

SEQ ID NO: 908 - protein, 11 aa, Artificial Sequence
  Description of Artificial Sequence: Synthetic peptide
WYRSPSYYENL

SEQ ID NO: 909 - protein, 11 aa, Artificial Sequence
  Description of Artificial Sequence: Synthetic peptide
WYRSPSYWENL

SEQ ID NO: 910 - protein, 11 aa, Artificial Sequence
  Description of Artificial Sequence: Synthetic peptide
WYRSPSDPENL

SEQ ID NO: 911 - protein, 11 aa, Artificial Sequence
  Description of Artificial Sequence: Synthetic peptide
WYRSPSDFENL

SEQ ID NO: 912 - protein, 11 aa, Artificial Sequence
  Description of Artificial Sequence: Synthetic peptide
WYRSPSDYENL

SEQ ID NO: 913 - protein, 11 aa, Artificial Sequence
  Description of Artificial Sequence: Synthetic peptide
WYRSPSDWENL

SEQ ID NO: 914 - protein, 11 aa, Artificial Sequence
  Description of Artificial Sequence: Synthetic peptide
WYRSPSEPENL

SEQ ID NO: 915 - protein, 11 aa, Artificial Sequence
  Description of Artificial Sequence: Synthetic peptide
WYRSPSEFENL

SEQ ID NO: 916 - protein, 11 aa, Artificial Sequence
  Description of Artificial Sequence: Synthetic peptide
WYRSPSEYENL

SEQ ID NO: 917 - protein, 11 aa, Artificial Sequence
  Description of Artificial Sequence: Synthetic peptide
WYRSPSEWENL

SEQ ID NO: 918 - protein, 11 aa, Artificial Sequence
  Description of Artificial Sequence: Synthetic peptide
WYRSPSNPENL

SEQ ID NO: 919 - protein, 11 aa, Artificial Sequence
  Description of Artificial Sequence: Synthetic peptide
WYRSPSNFENL

SEQ ID NO: 920 - protein, 11 aa, Artificial Sequence
  Description of Artificial Sequence: Synthetic peptide
WYRSPSNYENL

SEQ ID NO: 921 - protein, 11 aa, Artificial Sequence
  Description of Artificial Sequence: Synthetic peptide
WYRSPSNWENL

SEQ ID NO: 922 - protein, 11 aa, Artificial Sequence
  Description of Artificial Sequence: Synthetic peptide
WYRSPSQPENL

SEQ ID NO: 923 - protein, 11 aa, Artificial Sequence
  Description of Artificial Sequence: Synthetic peptide
WYRSPSQFENL

SEQ ID NO: 924 - protein, 11 aa, Artificial Sequence
  Description of Artificial Sequence: Synthetic peptide
WYRSPSQYENL

SEQ ID NO: 925 - protein, 11 aa, Artificial Sequence
  Description of Artificial Sequence: Synthetic peptide
WYRSPSQWENL

SEQ ID NO: 926 - protein, 11 aa, Artificial Sequence
  Description of Artificial Sequence: Synthetic peptide
WYRSPSHPENL

SEQ ID NO: 927 - protein, 11 aa, Artificial Sequence
  Description of Artificial Sequence: Synthetic peptide
WYRSPSHFENL

SEQ ID NO: 928 - protein, 11 aa, Artificial Sequence
  Description of Artificial Sequence: Synthetic peptide
WYRSPSHYENL

SEQ ID NO: 929 - protein, 11 aa, Artificial Sequence
  Description of Artificial Sequence: Synthetic peptide
WYRSPSHWENL

SEQ ID NO: 930 - protein, 11 aa, Artificial Sequence
  Description of Artificial Sequence: Synthetic peptide
WYSSPSMPENL

SEQ ID NO: 931 - protein, 11 aa, Artificial Sequence
  Description of Artificial Sequence: Synthetic peptide
WYSSPSMFENL

SEQ ID NO: 932 - protein, 11 aa, Artificial Sequence
  Description of Artificial Sequence: Synthetic peptide
WYSSPSMYENL

SEQ ID NO: 933 - protein, 11 aa, Artificial Sequence
  Description of Artificial Sequence: Synthetic peptide
WYSSPSMWENL

SEQ ID NO: 934 - protein, 11 aa, Artificial Sequence
  Description of Artificial Sequence: Synthetic peptide
WYSSPSFPENL

SEQ ID NO: 935 - protein, 11 aa, Artificial Sequence
  Description of Artificial Sequence: Synthetic peptide
WYSSPSFFENL

SEQ ID NO: 936 - protein, 11 aa, Artificial Sequence
  Description of Artificial Sequence: Synthetic peptide
WYSSPSFYENL

SEQ ID NO: 937 - protein, 11 aa, Artificial Sequence
  Description of Artificial Sequence: Synthetic peptide
WYSSPSFWENL

SEQ ID NO: 938 - protein, 11 aa, Artificial Sequence
  Description of Artificial Sequence: Synthetic peptide
WYSSPSYPENL

SEQ ID NO: 939 - protein, 11 aa, Artificial Sequence
  Description of Artificial Sequence: Synthetic peptide
WYSSPSYFENL

SEQ ID NO: 940 - protein, 11 aa, Artificial Sequence
  Description of Artificial Sequence: Synthetic peptide
WYSSPSYYENL

SEQ ID NO: 941 - protein, 11 aa, Artificial Sequence
  Description of Artificial Sequence: Synthetic peptide
WYSSPSYWENL

SEQ ID NO: 942 - protein, 11 aa, Artificial Sequence
  Description of Artificial Sequence: Synthetic peptide
WYSSPSDPENL

SEQ ID NO: 943 - protein, 11 aa, Artificial Sequence
  Description of Artificial Sequence: Synthetic peptide
WYSSPSDFENL

SEQ ID NO: 944 - protein, 11 aa, Artificial Sequence
  Description of Artificial Sequence: Synthetic peptide
WYSSPSDYENL

SEQ ID NO: 945 - protein, 11 aa, Artificial Sequence
  Description of Artificial Sequence: Synthetic peptide
WYSSPSDWENL

SEQ ID NO: 946 - protein, 11 aa, Artificial Sequence
  Description of Artificial Sequence: Synthetic peptide
WYSSPSEPENL

SEQ ID NO: 947 - protein, 11 aa, Artificial Sequence
  Description of Artificial Sequence: Synthetic peptide
WYSSPSEFENL

SEQ ID NO: 948 - protein, 11 aa, Artificial Sequence
  Description of Artificial Sequence: Synthetic peptide
WYSSPSEYENL

SEQ ID NO: 949 - protein, 11 aa, Artificial Sequence
  Description of Artificial Sequence: Synthetic peptide
WYSSPSEWENL

SEQ ID NO: 950 - protein, 11 aa, Artificial Sequence
  Description of Artificial Sequence: Synthetic peptide
WYSSPSNPENL

SEQ ID NO: 951 - protein, 11 aa, Artificial Sequence
  Description of Artificial Sequence: Synthetic peptide
WYSSPSNFENL

SEQ ID NO: 952 - protein, 11 aa, Artificial Sequence
  Description of Artificial Sequence: Synthetic peptide
WYSSPSNYENL

SEQ ID NO: 953 - protein, 11 aa, Artificial Sequence
  Description of Artificial Sequence: Synthetic peptide
WYSSPSNWENL

SEQ ID NO: 954 - protein, 11 aa, Artificial Sequence
  Description of Artificial Sequence: Synthetic peptide
WYSSPSQPENL

SEQ ID NO: 955 - protein, 11 aa, Artificial Sequence
  Description of Artificial Sequence: Synthetic peptide
WYSSPSQFENL

SEQ ID NO: 956 - protein, 11 aa, Artificial Sequence
  Description of Artificial Sequence: Synthetic peptide
WYSSPSQYENL

SEQ ID NO: 957 - protein, 11 aa, Artificial Sequence
  Description of Artificial Sequence: Synthetic peptide
WYSSPSQWENL

SEQ ID NO: 958 - protein, 11 aa, Artificial Sequence
  Description of Artificial Sequence: Synthetic peptide
WYSSPSHPENL

SEQ ID NO: 959 - protein, 11 aa, Artificial Sequence
  Description of Artificial Sequence: Synthetic peptide
WYSSPSHFENL

SEQ ID NO: 960 - protein, 11 aa, Artificial Sequence
  Description of Artificial Sequence: Synthetic peptide
WYSSPSHYENL

SEQ ID NO: 961 - protein, 11 aa, Artificial Sequence
  Description of Artificial Sequence: Synthetic peptide
WYSSPSHWENL

SEQ ID NO: 962 - protein, 11 aa, Artificial Sequence
  Description of Artificial Sequence: Synthetic peptide
WYTSPSMPENL

SEQ ID NO: 963 - protein, 11 aa, Artificial Sequence
  Description of Artificial Sequence: Synthetic peptide
WYTSPSMFENL

SEQ ID NO: 964 - protein, 11 aa, Artificial Sequence
  Description of Artificial Sequence: Synthetic peptide
WYTSPSMYENL

SEQ ID NO: 965 - protein, 11 aa, Artificial Sequence
  Description of Artificial Sequence: Synthetic peptide
WYTSPSMWENL

SEQ ID NO: 966 - protein, 11 aa, Artificial Sequence
  Description of Artificial Sequence: Synthetic peptide
WYTSPSFPENL

SEQ ID NO: 967 - protein, 11 aa, Artificial Sequence
  Description of Artificial Sequence: Synthetic peptide
WYTSPSFFENL

SEQ ID NO: 968 - protein, 11 aa, Artificial Sequence
  Description of Artificial Sequence: Synthetic peptide
WYTSPSFYENL

SEQ ID NO: 969 - protein, 11 aa, Artificial Sequence
  Description of Artificial Sequence: Synthetic peptide
WYTSPSFWENL

SEQ ID NO: 970 - protein, 11 aa, Artificial Sequence
  Description of Artificial Sequence: Synthetic peptide
WYTSPSYPENL

SEQ ID NO: 971 - protein, 11 aa, Artificial Sequence
  Description of Artificial Sequence: Synthetic peptide
WYTSPSYFENL

SEQ ID NO: 972 - protein, 11 aa, Artificial Sequence
  Description of Artificial Sequence: Synthetic peptide
WYTSPSYYENL

SEQ ID NO: 973 - protein, 11 aa, Artificial Sequence
  Description of Artificial Sequence: Synthetic peptide
WYTSPSYWENL

SEQ ID NO: 974 - protein, 11 aa, Artificial Sequence
  Description of Artificial Sequence: Synthetic peptide
WYTSPSDPENL

SEQ ID NO: 975 - protein, 11 aa, Artificial Sequence
  Description of Artificial Sequence: Synthetic peptide
WYTSPSDFENL

SEQ ID NO: 976 - protein, 11 aa, Artificial Sequence
  Description of Artificial Sequence: Synthetic peptide
WYTSPSDYENL

SEQ ID NO: 977 - protein, 11 aa, Artificial Sequence
  Description of Artificial Sequence: Synthetic peptide
WYTSPSDWENL

SEQ ID NO: 978 - protein, 11 aa, Artificial Sequence
  Description of Artificial Sequence: Synthetic peptide
WYTSPSEPENL

SEQ ID NO: 979 - protein, 11 aa, Artificial Sequence
  Description of Artificial Sequence: Synthetic peptide
WYTSPSEFENL

SEQ ID NO: 980 - protein, 11 aa, Artificial Sequence
  Description of Artificial Sequence: Synthetic peptide
WYTSPSEYENL

SEQ ID NO: 981 - protein, 11 aa, Artificial Sequence
  Description of Artificial Sequence: Synthetic peptide
WYTSPSEWENL

SEQ ID NO: 982 - protein, 11 aa, Artificial Sequence
  Description of Artificial Sequence: Synthetic peptide
WYTSPSNPENL

SEQ ID NO: 983 - protein, 11 aa, Artificial Sequence
  Description of Artificial Sequence: Synthetic peptide
WYTSPSNFENL

SEQ ID NO: 984 - protein, 11 aa, Artificial Sequence
  Description of Artificial Sequence: Synthetic peptide
WYTSPSNYENL

SEQ ID NO: 985 - protein, 11 aa, Artificial Sequence
  Description of Artificial Sequence: Synthetic peptide
WYTSPSNWENL

SEQ ID NO: 986 - protein, 11 aa, Artificial Sequence
  Description of Artificial Sequence: Synthetic peptide
WYTSPSQPENL

SEQ ID NO: 987 - protein, 11 aa, Artificial Sequence
  Description of Artificial Sequence: Synthetic peptide
WYTSPSQFENL

SEQ ID NO: 988 - protein, 11 aa, Artificial Sequence
  Description of Artificial Sequence: Synthetic peptide
WYTSPSQYENL

SEQ ID NO: 989 - protein, 11 aa, Artificial Sequence
  Description of Artificial Sequence: Synthetic peptide
WYTSPSQWENL

SEQ ID NO: 990 - protein, 11 aa, Artificial Sequence
  Description of Artificial Sequence: Synthetic peptide
WYTSPSHPENL

SEQ ID NO: 991 - protein, 11 aa, Artificial Sequence
  Description of Artificial Sequence: Synthetic peptide
WYTSPSHFENL

SEQ ID NO: 992 - protein, 11 aa, Artificial Sequence
  Description of Artificial Sequence: Synthetic peptide
WYTSPSHYENL

SEQ ID NO: 993 - protein, 11 aa, Artificial Sequence
  Description of Artificial Sequence: Synthetic peptide
WYTSPSHWENL

SEQ ID NO: 994 - protein, 11 aa, Artificial Sequence
  Description of Artificial Sequence: Synthetic peptide
WYHSPSMPENL

SEQ ID NO: 995 - protein, 11 aa, Artificial Sequence
  Description of Artificial Sequence: Synthetic peptide
WYHSPSMFENL

SEQ ID NO: 996 - protein, 11 aa, Artificial Sequence
  Description of Artificial Sequence: Synthetic peptide
WYHSPSMYENL

SEQ ID NO: 997 - protein, 11 aa, Artificial Sequence
  Description of Artificial Sequence: Synthetic peptide
WYHSPSMWENL

SEQ ID NO: 998 - protein, 11 aa, Artificial Sequence
  Description of Artificial Sequence: Synthetic peptide
WYHSPSFPENL

SEQ ID NO: 999 - protein, 11 aa, Artificial Sequence
  Description of Artificial Sequence: Synthetic peptide
WYHSPSFFENL

SEQ ID NO: 1000 - protein, 11 aa, Artificial Sequence
  Description of Artificial Sequence: Synthetic peptide
WYHSPSFYENL

SEQ ID NO: 1001 - protein, 11 aa, Artificial Sequence
  Description of Artificial Sequence: Synthetic peptide
WYHSPSFWENL

SEQ ID NO: 1002 - protein, 11 aa, Artificial Sequence
  Description of Artificial Sequence: Synthetic peptide
WYHSPSYPENL

SEQ ID NO: 1003 - protein, 11 aa, Artificial Sequence
  Description of Artificial Sequence: Synthetic peptide
WYHSPSYFENL

SEQ ID NO: 1004 - protein, 11 aa, Artificial Sequence
  Description of Artificial Sequence: Synthetic peptide
WYHSPSYYENL

SEQ ID NO: 1005 - protein, 11 aa, Artificial Sequence
  Description of Artificial Sequence: Synthetic peptide
WYHSPSYWENL

SEQ ID NO: 1006 - protein, 11 aa, Artificial Sequence
  Description of Artificial Sequence: Synthetic peptide
WYHSPSDPENL

SEQ ID NO: 1007 - protein, 11 aa, Artificial Sequence
  Description of Artificial Sequence: Synthetic peptide
WYHSPSDFENL

SEQ ID NO: 1008 - protein, 11 aa, Artificial Sequence
  Description of Artificial Sequence: Synthetic peptide
WYHSPSDYENL

SEQ ID NO: 1009 - protein, 11 aa, Artificial Sequence
  Description of Artificial Sequence: Synthetic peptide
WYHSPSDWENL

SEQ ID NO: 1010 - protein, 11 aa, Artificial Sequence
  Description of Artificial Sequence: Synthetic peptide
WYHSPSEPENL

SEQ ID NO: 1011 - protein, 11 aa, Artificial Sequence
  Description of Artificial Sequence: Synthetic peptide
WYHSPSEFENL

SEQ ID NO: 1012 - protein, 11 aa, Artificial Sequence
  Description of Artificial Sequence: Synthetic peptide
WYHSPSEYENL

SEQ ID NO: 1013 - protein, 11 aa, Artificial Sequence
  Description of Artificial Sequence: Synthetic peptide
WYHSPSEWENL

SEQ ID NO: 1014 - protein, 11 aa, Artificial Sequence
  Description of Artificial Sequence: Synthetic peptide
WYHSPSNPENL

SEQ ID NO: 1015 - protein, 11 aa, Artificial Sequence
  Description of Artificial Sequence: Synthetic peptide
WYHSPSNFENL

SEQ ID NO: 1016 - protein, 11 aa, Artificial Sequence
  Description of Artificial Sequence: Synthetic peptide
WYHSPSNYENL

SEQ ID NO: 1017 - protein, 11 aa, Artificial Sequence
  Description of Artificial Sequence: Synthetic peptide
WYHSPSNWENL

SEQ ID NO: 1018 - protein, 11 aa, Artificial Sequence
  Description of Artificial Sequence: Synthetic peptide
WYHSPSQPENL

SEQ ID NO: 1019 - protein, 11 aa, Artificial Sequence
  Description of Artificial Sequence: Synthetic peptide
WYHSPSQFENL

SEQ ID NO: 1020 - protein, 11 aa, Artificial Sequence
  Description of Artificial Sequence: Synthetic peptide
WYHSPSQYENL

SEQ ID NO: 1021 - protein, 11 aa, Artificial Sequence
  Description of Artificial Sequence: Synthetic peptide
WYHSPSQWENL

SEQ ID NO: 1022 - protein, 11 aa, Artificial Sequence
  Description of Artificial Sequence: Synthetic peptide
WYHSPSHPENL

SEQ ID NO: 1023 - protein, 11 aa, Artificial Sequence
  Description of Artificial Sequence: Synthetic peptide
WYHSPSHFENL

SEQ ID NO: 1024 - protein, 11 aa, Artificial Sequence
  Description of Artificial Sequence: Synthetic peptide
WYHSPSHYENL

SEQ ID NO: 1025 - protein, 11 aa, Artificial Sequence
  Description of Artificial Sequence: Synthetic peptide
WYHSPSHWENL

SEQ ID NO: 1026 - protein, 11 aa, Artificial Sequence
  Description of Artificial Sequence: Synthetic peptide
WYNSPSMPENL

SEQ ID NO: 1027 - protein, 11 aa, Artificial Sequence
  Description of Artificial Sequence: Synthetic peptide
WYNSPSMFENL

SEQ ID NO: 1028 - protein, 11 aa, Artificial Sequence
  Description of Artificial Sequence: Synthetic peptide
WYNSPSMYENL

SEQ ID NO: 1029 - protein, 11 aa, Artificial Sequence
  Description of Artificial Sequence: Synthetic peptide
WYNSPSMWENL

SEQ ID NO: 1030 - protein, 11 aa, Artificial Sequence
  Description of Artificial Sequence: Synthetic peptide
WYNSPSFPENL

SEQ ID NO: 1031 - protein, 11 aa, Artificial Sequence
  Description of Artificial Sequence: Synthetic peptide
WYNSPSFFENL

SEQ ID NO: 1032 - protein, 11 aa, Artificial Sequence
  Description of Artificial Sequence: Synthetic peptide
WYNSPSFYENL

SEQ ID NO: 1033 - protein, 11 aa, Artificial Sequence
  Description of Artificial Sequence: Synthetic peptide
WYNSPSFWENL

SEQ ID NO: 1034 - protein, 11 aa, Artificial Sequence
  Description of Artificial Sequence: Synthetic peptide
WYNSPSYPENL

SEQ ID NO: 1035 - protein, 11 aa, Artificial Sequence
  Description of Artificial Sequence: Synthetic peptide
WYNSPSYFENL

SEQ ID NO: 1036 - protein, 11 aa, Artificial Sequence
  Description of Artificial Sequence: Synthetic peptide
WYNSPSYYENL

SEQ ID NO: 1037 - protein, 11 aa, Artificial Sequence
  Description of Artificial Sequence: Synthetic peptide
WYNSPSYWENL

SEQ ID NO: 1038 - protein, 11 aa, Artificial Sequence
  Description of Artificial Sequence: Synthetic peptide
WYNSPSDPENL

SEQ ID NO: 1039 - protein, 11 aa, Artificial Sequence
  Description of Artificial Sequence: Synthetic peptide
WYNSPSDFENL

SEQ ID NO: 1040 - protein, 11 aa, Artificial Sequence
  Description of Artificial Sequence: Synthetic peptide
WYNSPSDYENL

SEQ ID NO: 1041 - protein, 11 aa, Artificial Sequence
  Description of Artificial Sequence: Synthetic peptide
WYNSPSDWENL

SEQ ID NO: 1042 - protein, 11 aa, Artificial Sequence
  Description of Artificial Sequence: Synthetic peptide
WYNSPSEPENL

SEQ ID NO: 1043 - protein, 11 aa, Artificial Sequence
  Description of Artificial Sequence: Synthetic peptide
WYNSPSEFENL

SEQ ID NO: 1044 - protein, 11 aa, Artificial Sequence
  Description of Artificial Sequence: Synthetic peptide
WYNSPSEYENL

SEQ ID NO: 1045 - protein, 11 aa, Artificial Sequence
  Description of Artificial Sequence: Synthetic peptide
WYNSPSEWENL

SEQ ID NO: 1046 - protein, 11 aa, Artificial Sequence
  Description of Artificial Sequence: Synthetic peptide
WYNSPSNPENL

SEQ ID NO: 1047 - protein, 11 aa, Artificial Sequence
  Description of Artificial Sequence: Synthetic peptide
WYNSPSNFENL

SEQ ID NO: 1048 - protein, 11 aa, Artificial Sequence
  Description of Artificial Sequence: Synthetic peptide
WYNSPSNYENL

SEQ ID NO: 1049 - protein, 11 aa, Artificial Sequence
  Description of Artificial Sequence: Synthetic peptide
WYNSPSNWENL

SEQ ID NO: 1050 - protein, 11 aa, Artificial Sequence
  Description of Artificial Sequence: Synthetic peptide
WYNSPSQPENL

SEQ ID NO: 1051 - protein, 11 aa, Artificial Sequence
  Description of Artificial Sequence: Synthetic peptide
WYNSPSQFENL

SEQ ID NO: 1052 - protein, 11 aa, Artificial Sequence
  Description of Artificial Sequence: Synthetic peptide
WYNSPSQYENL

SEQ ID NO: 1053 - protein, 11 aa, Artificial Sequence
  Description of Artificial Sequence: Synthetic peptide
WYNSPSQWENL

SEQ ID NO: 1054 - protein, 11 aa, Artificial Sequence
  Description of Artificial Sequence: Synthetic peptide
WYNSPSHPENL

SEQ ID NO: 1055 - protein, 11 aa, Artificial Sequence
  Description of Artificial Sequence: Synthetic peptide
WYNSPSHFENL

SEQ ID NO: 1056 - protein, 11 aa, Artificial Sequence
  Description of Artificial Sequence: Synthetic peptide
WYNSPSHYENL

SEQ ID NO: 1057 - protein, 11 aa, Artificial Sequence
  Description of Artificial Sequence: Synthetic peptide
WYNSPSHWENL

SEQ ID NO: 1058 - protein, 11 aa, Artificial Sequence
  Description of Artificial Sequence: Synthetic peptide
WYGSPSMPENL

SEQ ID NO: 1059 - protein, 11 aa, Artificial Sequence
  Description of Artificial Sequence: Synthetic peptide
WYGSPSMFENL

SEQ ID NO: 1060 - protein, 11 aa, Artificial Sequence
  Description of Artificial Sequence: Synthetic peptide
WYGSPSMYENL

SEQ ID NO: 1061 - protein, 11 aa, Artificial Sequence
  Description of Artificial Sequence: Synthetic peptide
WYGSPSMWENL

SEQ ID NO: 1062 - protein, 11 aa, Artificial Sequence
  Description of Artificial Sequence: Synthetic peptide
WYGSPSFPENL

SEQ ID NO: 1063 - protein, 11 aa, Artificial Sequence
  Description of Artificial Sequence: Synthetic peptide
WYGSPSFFENL

SEQ ID NO: 1064 - protein, 11 aa, Artificial Sequence
  Description of Artificial Sequence: Synthetic peptide
WYGSPSFYENL

SEQ ID NO: 1065 - protein, 11 aa, Artificial Sequence
  Description of Artificial Sequence: Synthetic peptide
WYGSPSFWENL

SEQ ID NO: 1066 - protein, 11 aa, Artificial Sequence
  Description of Artificial Sequence: Synthetic peptide
WYGSPSYPENL

SEQ ID NO: 1067 - protein, 11 aa, Artificial Sequence
  Description of Artificial Sequence: Synthetic peptide
WYGSPSYFENL

SEQ ID NO: 1068 - protein, 11 aa, Artificial Sequence
  Description of Artificial Sequence: Synthetic peptide
WYGSPSYYENL

SEQ ID NO: 1069 - protein, 11 aa, Artificial Sequence
  Description of Artificial Sequence: Synthetic peptide
WYGSPSYWENL

SEQ ID NO: 1070 - protein, 11 aa, Artificial Sequence
  Description of Artificial Sequence: Synthetic peptide
WYGSPSDPENL

SEQ ID NO: 1071 - protein, 11 aa, Artificial Sequence
  Description of Artificial Sequence: Synthetic peptide
WYGSPSDFENL

SEQ ID NO: 1072 - protein, 11 aa, Artificial Sequence
  Description of Artificial Sequence: Synthetic peptide
WYGSPSDYENL

SEQ ID NO: 1073 - protein, 11 aa, Artificial Sequence
  Description of Artificial Sequence: Synthetic peptide
WYGSPSDWENL

SEQ ID NO: 1074 - protein, 11 aa, Artificial Sequence
  Description of Artificial Sequence: Synthetic peptide
WYGSPSEPENL

SEQ ID NO: 1075 - protein, 11 aa, Artificial Sequence
  Description of Artificial Sequence: Synthetic peptide
WYGSPSEFENL

SEQ ID NO: 1076 - protein, 11 aa, Artificial Sequence
  Description of Artificial Sequence: Synthetic peptide
WYGSPSEYENL

SEQ ID NO: 1077 - protein, 11 aa, Artificial Sequence
  Description of Artificial Sequence: Synthetic peptide
WYGSPSEWENL

SEQ ID NO: 1078 - protein, 11 aa, Artificial Sequence
  Description of Artificial Sequence: Synthetic peptide
WYGSPSNPENL

SEQ ID NO: 1079 - protein, 11 aa, Artificial Sequence
  Description of Artificial Sequence: Synthetic peptide
WYGSPSNFENL

SEQ ID NO: 1080 - protein, 11 aa, Artificial Sequence
  Description of Artificial Sequence: Synthetic peptide
WYGSPSNYENL

SEQ ID NO: 1081 - protein, 11 aa, Artificial Sequence
  Description of Artificial Sequence: Synthetic peptide
WYGSPSNWENL

SEQ ID NO: 1082 - protein, 11 aa, Artificial Sequence
  Description of Artificial Sequence: Synthetic peptide
WYGSPSQPENL

SEQ ID NO: 1083 - protein, 11 aa, Artificial Sequence
  Description of Artificial Sequence: Synthetic peptide
WYGSPSQFENL

SEQ ID NO: 1084 - protein, 11 aa, Artificial Sequence
  Description of Artificial Sequence: Synthetic peptide
WYGSPSQYENL

SEQ ID NO: 1085 - protein, 11 aa, Artificial Sequence
  Description of Artificial Sequence: Synthetic peptide
WYGSPSQWENL

SEQ ID NO: 1086 - protein, 11 aa, Artificial Sequence
  Description of Artificial Sequence: Synthetic peptide
WYGSPSHPENL

SEQ ID NO: 1087 - protein, 11 aa, Artificial Sequence
  Description of Artificial Sequence: Synthetic peptide
WYGSPSHFENL

SEQ ID NO: 1088 - protein, 11 aa, Artificial Sequence
  Description of Artificial Sequence: Synthetic peptide
WYGSPSHYENL

SEQ ID NO: 1089 - protein, 11 aa, Artificial Sequence
  Description of Artificial Sequence: Synthetic peptide
WYGSPSHWENL

SEQ ID NO: 1090 - protein, 11 aa, Artificial Sequence
  Description of Artificial Sequence: Synthetic peptide
WYASPSMPENL

SEQ ID NO: 1091 - protein, 11 aa, Artificial Sequence
  Description of Artificial Sequence: Synthetic peptide
WYASPSMFENL

SEQ ID NO: 1092 - protein, 11 aa, Artificial Sequence
  Description of Artificial Sequence: Synthetic peptide
WYASPSMYENL

SEQ ID NO: 1093 - protein, 11 aa, Artificial Sequence
  Description of Artificial Sequence: Synthetic peptide
WYASPSMWENL

SEQ ID NO: 1094 - protein, 11 aa, Artificial Sequence
  Description of Artificial Sequence: Synthetic peptide
WYASPSFPENL

SEQ ID NO: 1095 - protein, 11 aa, Artificial Sequence
  Description of Artificial Sequence: Synthetic peptide
WYASPSFFENL

SEQ ID NO: 1096 - protein, 11 aa, Artificial Sequence
  Description of Artificial Sequence: Synthetic peptide
WYASPSFYENL

SEQ ID NO: 1097 - protein, 11 aa, Artificial Sequence
  Description of Artificial Sequence: Synthetic peptide
WYASPSFWENL

SEQ ID NO: 1098 - protein, 11 aa, Artificial Sequence
  Description of Artificial Sequence: Synthetic peptide
WYASPSYPENL

SEQ ID NO: 1099 - protein, 11 aa, Artificial Sequence
  Description of Artificial Sequence: Synthetic peptide
WYASPSYFENL

SEQ ID NO: 1100 - protein, 11 aa, Artificial Sequence
  Description of Artificial Sequence: Synthetic peptide
WYASPSYYENL

SEQ ID NO: 1101 - protein, 11 aa, Artificial Sequence
  Description of Artificial Sequence: Synthetic peptide
WYASPSYWENL

SEQ ID NO: 1102 - protein, 11 aa, Artificial Sequence
  Description of Artificial Sequence: Synthetic peptide
WYASPSDPENL

SEQ ID NO: 1103 - protein, 11 aa, Artificial Sequence
  Description of Artificial Sequence: Synthetic peptide
WYASPSDFENL

SEQ ID NO: 1104 - protein, 11 aa, Artificial Sequence
  Description of Artificial Sequence: Synthetic peptide
WYASPSDYENL

SEQ ID NO: 1105 - protein, 11 aa, Artificial Sequence
  Description of Artificial Sequence: Synthetic peptide
WYASPSDWENL

SEQ ID NO: 1106 - protein, 11 aa, Artificial Sequence
  Description of Artificial Sequence: Synthetic peptide
WYASPSEPENL

SEQ ID NO: 1107 - protein, 11 aa, Artificial Sequence
  Description of Artificial Sequence: Synthetic peptide
WYASPSEFENL

SEQ ID NO: 1108 - protein, 11 aa, Artificial Sequence
  Description of Artificial Sequence: Synthetic peptide
WYASPSEYENL

SEQ ID NO: 1109 - protein, 11 aa, Artificial Sequence
  Description of Artificial Sequence: Synthetic peptide
WYASPSEWENL

SEQ ID NO: 1110 - protein, 11 aa, Artificial Sequence
  Description of Artificial Sequence: Synthetic peptide
WYASPSNPENL

SEQ ID NO: 1111 - protein, 11 aa, Artificial Sequence
  Description of Artificial Sequence: Synthetic peptide
WYASPSNFENL

SEQ ID NO: 1112 - protein, 11 aa, Artificial Sequence
  Description of Artificial Sequence: Synthetic peptide
WYASPSNYENL

SEQ ID NO: 1113 - protein, 11 aa, Artificial Sequence
  Description of Artificial Sequence: Synthetic peptide
WYASPSNWENL

SEQ ID NO: 1114 - protein, 11 aa, Artificial Sequence
  Description of Artificial Sequence: Synthetic peptide
WYASPSQPENL

SEQ ID NO: 1115 - protein, 11 aa, Artificial Sequence
  Description of Artificial Sequence: Synthetic peptide
WYASPSQFENL

SEQ ID NO: 1116 - protein, 11 aa, Artificial Sequence
  Description of Artificial Sequence: Synthetic peptide
WYASPSQYENL

SEQ ID NO: 1117 - protein, 11 aa, Artificial Sequence
  Description of Artificial Sequence: Synthetic peptide
WYASPSQWENL

SEQ ID NO: 1118 - protein, 11 aa, Artificial Sequence
  Description of Artificial Sequence: Synthetic peptide
WYASPSHPENL

SEQ ID NO: 1119 - protein, 11 aa, Artificial Sequence
  Description of Artificial Sequence: Synthetic peptide
WYASPSHFENL

SEQ ID NO: 1120 - protein, 11 aa, Artificial Sequence
  Description of Artificial Sequence: Synthetic peptide
WYASPSHYENL

SEQ ID NO: 1121 - protein, 11 aa, Artificial Sequence
  Description of Artificial Sequence: Synthetic peptide
WYASPSHWENL

SEQ ID NO: 1122 - protein, 11 aa, Artificial Sequence
  Description of Artificial Sequence: Synthetic peptide
WFRSPSMPENL

SEQ ID NO: 1123 - protein, 11 aa, Artificial Sequence
  Description of Artificial Sequence: Synthetic peptide
WFRSPSMFENL

SEQ ID NO: 1124 - protein, 11 aa, Artificial Sequence
  Description of Artificial Sequence: Synthetic peptide
WFRSPSMYENL

SEQ ID NO: 1125 - protein, 11 aa, Artificial Sequence
  Description of Artificial Sequence: Synthetic peptide
WFRSPSMWENL

SEQ ID NO: 1126 - protein, 11 aa, Artificial Sequence
  Description of Artificial Sequence: Synthetic peptide
WFRSPSFPENL

SEQ ID NO: 1127 - protein, 11 aa, Artificial Sequence
  Description of Artificial Sequence: Synthetic peptide
WFRSPSFFENL

SEQ ID NO: 1128 - protein, 11 aa, Artificial Sequence
  Description of Artificial Sequence: Synthetic peptide
WFRSPSFYENL

SEQ ID NO: 1129 - protein, 11 aa, Artificial Sequence
  Description of Artificial Sequence: Synthetic peptide
WFRSPSFWENL

SEQ ID NO: 1130 - protein, 11 aa, Artificial Sequence
  Description of Artificial Sequence: Synthetic peptide
WFRSPSYPENL

SEQ ID NO: 1131 - protein, 11 aa, Artificial Sequence
  Description of Artificial Sequence: Synthetic peptide
WFRSPSYFENL

SEQ ID NO: 1132 - protein, 11 aa, Artificial Sequence
  Description of Artificial Sequence: Synthetic peptide
WFRSPSYYENL

SEQ ID NO: 1133 - protein, 11 aa, Artificial Sequence
  Description of Artificial Sequence: Synthetic peptide
WFRSPSYWENL

SEQ ID NO: 1134 - protein, 11 aa, Artificial Sequence
  Description of Artificial Sequence: Synthetic peptide
WFRSPSDPENL

SEQ ID NO: 1135 - protein, 11 aa, Artificial Sequence
  Description of Artificial Sequence: Synthetic peptide
WFRSPSDFENL

SEQ ID NO: 1136 - protein, 11 aa, Artificial Sequence
  Description of Artificial Sequence: Synthetic peptide
WFRSPSDYENL

SEQ ID NO: 1137 - protein, 11 aa, Artificial Sequence
  Description of Artificial Sequence: Synthetic peptide
WFRSPSDWENL

SEQ ID NO: 1138 - protein, 11 aa, Artificial Sequence
  Description of Artificial Sequence: Synthetic peptide
WFRSPSEPENL

SEQ ID NO: 1139 - protein, 11 aa, Artificial Sequence
  Description of Artificial Sequence: Synthetic peptide
WFRSPSEFENL

SEQ ID NO: 1140 - protein, 11 aa, Artificial Sequence
  Description of Artificial Sequence: Synthetic peptide
WFRSPSEYENL

SEQ ID NO: 1141 - protein, 11 aa, Artificial Sequence
  Description of Artificial Sequence: Synthetic peptide
WFRSPSEWENL

SEQ ID NO: 1142 - protein, 11 aa, Artificial Sequence
  Description of Artificial Sequence: Synthetic peptide
WFRSPSNPENL

SEQ ID NO: 1143 - protein, 11 aa, Artificial Sequence
  Description of Artificial Sequence: Synthetic peptide
WFRSPSNFENL

SEQ ID NO: 1144 - protein, 11 aa, Artificial Sequence
  Description of Artificial Sequence: Synthetic peptide
WFRSPSNYENL

SEQ ID NO: 1145 - protein, 11 aa, Artificial Sequence
  Description of Artificial Sequence: Synthetic peptide
WFRSPSNWENL

SEQ ID NO: 1146 - protein, 11 aa, Artificial Sequence
  Description of Artificial Sequence: Synthetic peptide
WFRSPSQPENL

SEQ ID NO: 1147 - protein, 11 aa, Artificial Sequence
  Description of Artificial Sequence: Synthetic peptide
WFRSPSQFENL

SEQ ID NO: 1148 - protein, 11 aa, Artificial Sequence
  Description of Artificial Sequence: Synthetic peptide
WFRSPSQYENL

SEQ ID NO: 1149 - protein, 11 aa, Artificial Sequence
  Description of Artificial Sequence: Synthetic peptide
WFRSPSQWENL

SEQ ID NO: 1150 - protein, 11 aa, Artificial Sequence
  Description of Artificial Sequence: Synthetic peptide
WFRSPSHPENL

SEQ ID NO: 1151 - protein, 11 aa, Artificial Sequence
  Description of Artificial Sequence: Synthetic peptide
WFRSPSHFENL

SEQ ID NO: 1152 - protein, 11 aa, Artificial Sequence
  Description of Artificial Sequence: Synthetic peptide
WFRSPSHYENL

SEQ ID NO: 1153 - protein, 11 aa, Artificial Sequence
  Description of Artificial Sequence: Synthetic peptide
WFRSPSHWENL

SEQ ID NO: 1154 - protein, 11 aa, Artificial Sequence
  Description of Artificial Sequence: Synthetic peptide
WFSSPSMPENL

SEQ ID NO: 1155 - protein, 11 aa, Artificial Sequence
  Description of Artificial Sequence: Synthetic peptide
WFSSPSMFENL

SEQ ID NO: 1156 - protein, 11 aa, Artificial Sequence
  Description of Artificial Sequence: Synthetic peptide
WFSSPSMYENL

SEQ ID NO: 1157 - protein, 11 aa, Artificial Sequence
  Description of Artificial Sequence: Synthetic peptide
WFSSPSMWENL

SEQ ID NO: 1158 - protein, 11 aa, Artificial Sequence
  Description of Artificial Sequence: Synthetic peptide
WFSSPSFPENL

SEQ ID NO: 1159 - protein, 11 aa, Artificial Sequence
  Description of Artificial Sequence: Synthetic peptide
WFSSPSFFENL

SEQ ID NO: 1160 - protein, 11 aa, Artificial Sequence
  Description of Artificial Sequence: Synthetic peptide
WFSSPSFYENL

SEQ ID NO: 1161 - protein, 11 aa, Artificial Sequence
  Description of Artificial Sequence: Synthetic peptide
WFSSPSFWENL

SEQ ID NO: 1162 - protein, 11 aa, Artificial Sequence
  Description of Artificial Sequence: Synthetic peptide
WFSSPSYPENL

SEQ ID NO: 1163 - protein, 11 aa, Artificial Sequence
  Description of Artificial Sequence: Synthetic peptide
WFSSPSYFENL

SEQ ID NO: 1164 - protein, 11 aa, Artificial Sequence
  Description of Artificial Sequence: Synthetic peptide
WFSSPSYYENL

SEQ ID NO: 1165 - protein, 11 aa, Artificial Sequence
  Description of Artificial Sequence: Synthetic peptide
WFSSPSYWENL

SEQ ID NO: 1166 - protein, 11 aa, Artificial Sequence
  Description of Artificial Sequence: Synthetic peptide
WFSSPSDPENL

SEQ ID NO: 1167 - protein, 11 aa, Artificial Sequence
  Description of Artificial Sequence: Synthetic peptide
WFSSPSDFENL

SEQ ID NO: 1168 - protein, 11 aa, Artificial Sequence
  Description of Artificial Sequence: Synthetic peptide
WFSSPSDYENL

SEQ ID NO: 1169 - protein, 11 aa, Artificial Sequence
  Description of Artificial Sequence: Synthetic peptide
WFSSPSDWENL

SEQ ID NO: 1170 - protein, 11 aa, Artificial Sequence
  Description of Artificial Sequence: Synthetic peptide
WFSSPSEPENL

SEQ ID NO: 1171 - protein, 11 aa, Artificial Sequence
  Description of Artificial Sequence: Synthetic peptide
WFSSPSEFENL

SEQ ID NO: 1172 - protein, 11 aa, Artificial Sequence
  Description of Artificial Sequence: Synthetic peptide
WFSSPSEYENL

SEQ ID NO: 1173 - protein, 11 aa, Artificial Sequence
  Description of Artificial Sequence: Synthetic peptide
WFSSPSEWENL

SEQ ID NO: 1174 - protein, 11 aa, Artificial Sequence
  Description of Artificial Sequence: Synthetic peptide
WFSSPSNPENL

SEQ ID NO: 1175 - protein, 11 aa, Artificial Sequence
  Description of Artificial Sequence: Synthetic peptide
WFSSPSNFENL

SEQ ID NO: 1176 - protein, 11 aa, Artificial Sequence
  Description of Artificial Sequence: Synthetic peptide
WFSSPSNYENL

SEQ ID NO: 1177 - protein, 11 aa, Artificial Sequence
  Description of Artificial Sequence: Synthetic peptide
WFSSPSNWENL

SEQ ID NO: 1178 - protein, 11 aa, Artificial Sequence
  Description of Artificial Sequence: Synthetic peptide
WFSSPSQPENL

SEQ ID NO: 1179 - protein, 11 aa, Artificial Sequence
  Description of Artificial Sequence: Synthetic peptide
WFSSPSQFENL

SEQ ID NO: 1180 - protein, 11 aa, Artificial Sequence
  Description of Artificial Sequence: Synthetic peptide
WFSSPSQYENL

SEQ ID NO: 1181 - protein, 11 aa, Artificial Sequence
  Description of Artificial Sequence: Synthetic peptide
WFSSPSQWENL

SEQ ID NO: 1182 - protein, 11 aa, Artificial Sequence
  Description of Artificial Sequence: Synthetic peptide
WFSSPSHPENL

SEQ ID NO: 1183 - protein, 11 aa, Artificial Sequence
  Description of Artificial Sequence: Synthetic peptide
WFSSPSHFENL

SEQ ID NO: 1184 - protein, 11 aa, Artificial Sequence
  Description of Artificial Sequence: Synthetic peptide
WFSSPSHYENL

SEQ ID NO: 1185 - protein, 11 aa, Artificial Sequence
  Description of Artificial Sequence: Synthetic peptide
WFSSPSHWENL

SEQ ID NO: 1186 - protein, 11 aa, Artificial Sequence
  Description of Artificial Sequence: Synthetic peptide
WFTSPSMPENL

SEQ ID NO: 1187 - protein, 11 aa, Artificial Sequence
  Description of Artificial Sequence: Synthetic peptide
WFTSPSMFENL

SEQ ID NO: 1188 - protein, 11 aa, Artificial Sequence
  Description of Artificial Sequence: Synthetic peptide
WFTSPSMYENL

SEQ ID NO: 1189 - protein, 11 aa, Artificial Sequence
  Description of Artificial Sequence: Synthetic peptide
WFTSPSMWENL

SEQ ID NO: 1190 - protein, 11 aa, Artificial Sequence
  Description of Artificial Sequence: Synthetic peptide
WFTSPSFPENL

SEQ ID NO: 1191 - protein, 11 aa, Artificial Sequence
  Description of Artificial Sequence: Synthetic peptide
WFTSPSFFENL

SEQ ID NO: 1192 - protein, 11 aa, Artificial Sequence
  Description of Artificial Sequence: Synthetic peptide
WFTSPSFYENL

SEQ ID NO: 1193 - protein, 11 aa, Artificial Sequence
  Description of Artificial Sequence: Synthetic peptide
WFTSPSFWENL

SEQ ID NO: 1194 - protein, 11 aa, Artificial Sequence
  Description of Artificial Sequence: Synthetic peptide
WFTSPSYPENL

SEQ ID NO: 1195 - protein, 11 aa, Artificial Sequence
  Description of Artificial Sequence: Synthetic peptide
WFTSPSYFENL

SEQ ID NO: 1196 - protein, 11 aa, Artificial Sequence
  Description of Artificial Sequence: Synthetic peptide
WFTSPSYYENL

SEQ ID NO: 1197 - protein, 11 aa, Artificial Sequence
  Description of Artificial Sequence: Synthetic peptide
WFTSPSYWENL

SEQ ID NO: 1198 - protein, 11 aa, Artificial Sequence
  Description of Artificial Sequence: Synthetic peptide
WFTSPSDPENL

SEQ ID NO: 1199 - protein, 11 aa, Artificial Sequence
  Description of Artificial Sequence: Synthetic peptide
WFTSPSDFENL

SEQ ID NO: 1200 - protein, 11 aa, Artificial Sequence
  Description of Artificial Sequence: Synthetic peptide
WFTSPSDYENL

SEQ ID NO: 1201 - protein, 11 aa, Artificial Sequence
  Description of Artificial Sequence: Synthetic peptide
WFTSPSDWENL

SEQ ID NO: 1202 - protein, 11 aa, Artificial Sequence
  Description of Artificial Sequence: Synthetic peptide
WFTSPSEPENL

SEQ ID NO: 1203 - protein, 11 aa, Artificial Sequence
  Description of Artificial Sequence: Synthetic peptide
WFTSPSEFENL

SEQ ID NO: 1204 - protein, 11 aa, Artificial Sequence
  Description of Artificial Sequence: Synthetic peptide
WFTSPSEYENL

SEQ ID NO: 1205 - protein, 11 aa, Artificial Sequence
  Description of Artificial Sequence: Synthetic peptide
WFTSPSEWENL

SEQ ID NO: 1206 - protein, 11 aa, Artificial Sequence
  Description of Artificial Sequence: Synthetic peptide
PSNWFTSPENL

SEQ ID NO: 1207 - protein, 11 aa, Artificial Sequence
  Description of Artificial Sequence: Synthetic peptide
WFTSPSNFENL

SEQ ID NO: 1208 - protein, 11 aa, Artificial Sequence
  Description of Artificial Sequence: Synthetic peptide
WFTSPSNYENL

SEQ ID NO: 1209 - protein, 11 aa, Artificial Sequence
  Description of Artificial Sequence: Synthetic peptide
WFTSPSNWENL

SEQ ID NO: 1210 - protein, 11 aa, Artificial Sequence
  Description of Artificial Sequence: Synthetic peptide
WFTSPSQPENL

SEQ ID NO: 1211 - protein, 11 aa, Artificial Sequence
  Description of Artificial Sequence: Synthetic peptide
WFTSPSQFENL

SEQ ID NO: 1212 - protein, 11 aa, Artificial Sequence
  Description of Artificial Sequence: Synthetic peptide
WFTSPSQYENL

SEQ ID NO: 1213 - protein, 11 aa, Artificial Sequence
  Description of Artificial Sequence: Synthetic peptide
WFTSPSQWENL

SEQ ID NO: 1214 - protein, 11 aa, Artificial Sequence
  Description of Artificial Sequence: Synthetic peptide
WFTSPSHPENL

SEQ ID NO: 1215 - protein, 11 aa, Artificial Sequence
  Description of Artificial Sequence: Synthetic peptide
WFTSPSHFENL

SEQ ID NO: 1216 - protein, 11 aa, Artificial Sequence
  Description of Artificial Sequence: Synthetic peptide
WFTSPSHYENL

SEQ ID NO: 1217 - protein, 11 aa, Artificial Sequence
  Description of Artificial Sequence: Synthetic peptide
WFTSPSHWENL

SEQ ID NO: 1218 - protein, 11 aa, Artificial Sequence
  Description of Artificial Sequence: Synthetic peptide
WFHSPSMPENL

SEQ ID NO: 1219 - protein, 11 aa, Artificial Sequence
  Description of Artificial Sequence: Synthetic peptide
WFHSPSMFENL

SEQ ID NO: 1220 - protein, 11 aa, Artificial Sequence
  Description of Artificial Sequence: Synthetic peptide
WFHSPSMYENL

SEQ ID NO: 1221 - protein, 11 aa, Artificial Sequence
  Description of Artificial Sequence: Synthetic peptide
WFHSPSMWENL

SEQ ID NO: 1222 - protein, 11 aa, Artificial Sequence
  Description of Artificial Sequence: Synthetic peptide
WFHSPSFPENL

SEQ ID NO: 1223 - protein, 11 aa, Artificial Sequence
  Description of Artificial Sequence: Synthetic peptide
WFHSPSFFENL

SEQ ID NO: 1224 - protein, 11 aa, Artificial Sequence
  Description of Artificial Sequence: Synthetic peptide
WFHSPSFYENL

SEQ ID NO: 1225 - protein, 11 aa, Artificial Sequence
  Description of Artificial Sequence: Synthetic peptide
WFHSPSFWENL

SEQ ID NO: 1226 - protein, 11 aa, Artificial Sequence
  Description of Artificial Sequence: Synthetic peptide
WFHSPSYPENL

SEQ ID NO: 1227 - protein, 11 aa, Artificial Sequence
  Description of Artificial Sequence: Synthetic peptide
WFHSPSYFENL

SEQ ID NO: 1228 - protein, 11 aa, Artificial Sequence
  Description of Artificial Sequence: Synthetic peptide
WFHSPSYYENL

SEQ ID NO: 1229 - protein, 11 aa, Artificial Sequence
  Description of Artificial Sequence: Synthetic peptide
WFHSPSYWENL

SEQ ID NO: 1230 - protein, 11 aa, Artificial Sequence
  Description of Artificial Sequence: Synthetic peptide
WFHSPSDPENL

SEQ ID NO: 1231 - protein, 11 aa, Artificial Sequence
  Description of Artificial Sequence: Synthetic peptide
WFHSPSDFENL

SEQ ID NO: 1232 - protein, 11 aa, Artificial Sequence
  Description of Artificial Sequence: Synthetic peptide
WFHSPSDYENL

SEQ ID NO: 1233 - protein, 11 aa, Artificial Sequence
  Description of Artificial Sequence: Synthetic peptide
WFHSPSDWENL

SEQ ID NO: 1234 - protein, 11 aa, Artificial Sequence
  Description of Artificial Sequence: Synthetic peptide
WFHSPSEPENL

SEQ ID NO: 1235 - protein, 11 aa, Artificial Sequence
  Description of Artificial Sequence: Synthetic peptide
WFHSPSEFENL

SEQ ID NO: 1236 - protein, 11 aa, Artificial Sequence
  Description of Artificial Sequence: Synthetic peptide
WFHSPSEYENL

SEQ ID NO: 1237 - protein, 11 aa, Artificial Sequence
  Description of Artificial Sequence: Synthetic peptide
WFHSPSEWENL

SEQ ID NO: 1238 - protein, 11 aa, Artificial Sequence
  Description of Artificial Sequence: Synthetic peptide
WFHSPSNPENL

SEQ ID NO: 1239 - protein, 11 aa, Artificial Sequence
  Description of Artificial Sequence: Synthetic peptide
WFHSPSNFENL

SEQ ID NO: 1240 - protein, 11 aa, Artificial Sequence
  Description of Artificial Sequence: Synthetic peptide
WFHSPSNYENL

SEQ ID NO: 1241 - protein, 11 aa, Artificial Sequence
  Description of Artificial Sequence: Synthetic peptide
WFHSPSNWENL

SEQ ID NO: 1242 - protein, 11 aa, Artificial Sequence
  Description of Artificial Sequence: Synthetic peptide
WFHSPSQPENL

SEQ ID NO: 1243 - protein, 11 aa, Artificial Sequence
  Description of Artificial Sequence: Synthetic peptide
WFHSPSQFENL

SEQ ID NO: 1244 - protein, 11 aa, Artificial Sequence
  Description of Artificial Sequence: Synthetic peptide
WFHSPSQYENL

SEQ ID NO: 1245 - protein, 11 aa, Artificial Sequence
  Description of Artificial Sequence: Synthetic peptide
WFHSPSQWENL

SEQ ID NO: 1246 - protein, 11 aa, Artificial Sequence
  Description of Artificial Sequence: Synthetic peptide
WFHSPSHPENL

SEQ ID NO: 1247 - protein, 11 aa, Artificial Sequence
  Description of Artificial Sequence: Synthetic peptide
WFHSPSHFENL

SEQ ID NO: 1248 - protein, 11 aa, Artificial Sequence
  Description of Artificial Sequence: Synthetic peptide
WFHSPSHYENL

SEQ ID NO: 1249 - protein, 11 aa, Artificial Sequence
  Description of Artificial Sequence: Synthetic peptide
WFHSPSHWENL

SEQ ID NO: 1250 - protein, 11 aa, Artificial Sequence
  Description of Artificial Sequence: Synthetic peptide
WFNSPSMPENL

SEQ ID NO: 1251 - protein, 11 aa, Artificial Sequence
  Description of Artificial Sequence: Synthetic peptide
WFNSPSMFENL

SEQ ID NO: 1252 - protein, 11 aa, Artificial Sequence
  Description of Artificial Sequence: Synthetic peptide
WFNSPSMYENL

SEQ ID NO: 1253 - protein, 11 aa, Artificial Sequence
  Description of Artificial Sequence: Synthetic peptide
WFNSPSMWENL

SEQ ID NO: 1254 - protein, 11 aa, Artificial Sequence
  Description of Artificial Sequence: Synthetic peptide
WFNSPSFPENL

SEQ ID NO: 1255 - protein, 11 aa, Artificial Sequence
  Description of Artificial Sequence: Synthetic peptide
WFNSPSFFENL

SEQ ID NO: 1256 - protein, 11 aa, Artificial Sequence
  Description of Artificial Sequence: Synthetic peptide
WFNSPSFYENL

SEQ ID NO: 1257 - protein, 11 aa, Artificial Sequence
  Description of Artificial Sequence: Synthetic peptide
WFNSPSFWENL

SEQ ID NO: 1258 - protein, 11 aa, Artificial Sequence
  Description of Artificial Sequence: Synthetic peptide
WFNSPSYPENL

SEQ ID NO: 1259 - protein, 11 aa, Artificial Sequence
  Description of Artificial Sequence: Synthetic peptide
WFNSPSYFENL

SEQ ID NO: 1260 - protein, 11 aa, Artificial Sequence
  Description of Artificial Sequence: Synthetic peptide
WFNSPSYYENL

SEQ ID NO: 1261 - protein, 11 aa, Artificial Sequence
  Description of Artificial Sequence: Synthetic peptide
WFNSPSYWENL

SEQ ID NO: 1262 - protein, 11 aa, Artificial Sequence
  Description of Artificial Sequence: Synthetic peptide
WFNSPSDPENL

SEQ ID NO: 1263 - protein, 11 aa, Artificial Sequence
  Description of Artificial Sequence: Synthetic peptide
WFNSPSDFENL

SEQ ID NO: 1264 - protein, 11 aa, Artificial Sequence
  Description of Artificial Sequence: Synthetic peptide
WFNSPSDYENL

SEQ ID NO: 1265 - protein, 11 aa, Artificial Sequence
  Description of Artificial Sequence: Synthetic peptide
WFNSPSDWENL

SEQ ID NO: 1266 - protein, 11 aa, Artificial Sequence
  Description of Artificial Sequence: Synthetic peptide
WFNSPSEPENL

SEQ ID NO: 1267 - protein, 11 aa, Artificial Sequence
  Description of Artificial Sequence: Synthetic peptide
WFNSPSEFENL

SEQ ID NO: 1268 - protein, 11 aa, Artificial Sequence
  Description of Artificial Sequence: Synthetic peptide
WFNSPSEYENL

SEQ ID NO: 1269 - protein, 11 aa, Artificial Sequence
  Description of Artificial Sequence: Synthetic peptide
WFNSPSEWENL

SEQ ID NO: 1270 - protein, 11 aa, Artificial Sequence
  Description of Artificial Sequence: Synthetic peptide
WFNSPSNPENL

SEQ ID NO: 1271 - protein, 11 aa, Artificial Sequence
  Description of Artificial Sequence: Synthetic peptide
WFNSPSNFENL

SEQ ID NO: 1272 - protein, 11 aa, Artificial Sequence
  Description of Artificial Sequence: Synthetic peptide
WFNSPSNYENL

SEQ ID NO: 1273 - protein, 11 aa, Artificial Sequence
  Description of Artificial Sequence: Synthetic peptide
WFNSPSNWENL

SEQ ID NO: 1274 - protein, 11 aa, Artificial Sequence
  Description of Artificial Sequence: Synthetic peptide
WFNSPSQPENL

SEQ ID NO: 1275 - protein, 11 aa, Artificial Sequence
  Description of Artificial Sequence: Synthetic peptide
WFNSPSQFENL

SEQ ID NO: 1276 - protein, 11 aa, Artificial Sequence
  Description of Artificial Sequence: Synthetic peptide
WFNSPSQYENL

SEQ ID NO: 1277 - protein, 11 aa, Artificial Sequence
  Description of Artificial Sequence: Synthetic peptide
WFNSPSQWENL

SEQ ID NO: 1278 - protein, 11 aa, Artificial Sequence
  Description of Artificial Sequence: Synthetic peptide
WFNSPSHPENL

SEQ ID NO: 1279 - protein, 11 aa, Artificial Sequence
  Description of Artificial Sequence: Synthetic peptide
WFNSPSHFENL

SEQ ID NO: 1280 - protein, 11 aa, Artificial Sequence
  Description of Artificial Sequence: Synthetic peptide
WFNSPSHYENL

SEQ ID NO: 1281 - protein, 11 aa, Artificial Sequence
  Description of Artificial Sequence: Synthetic peptide
WFNSPSHWENL

SEQ ID NO: 1282 - protein, 11 aa, Artificial Sequence
  Description of Artificial Sequence: Synthetic peptide
WFGSPSMPENL

SEQ ID NO: 1283 - protein, 11 aa, Artificial Sequence
  Description of Artificial Sequence: Synthetic peptide
WFGSPSMFENL

SEQ ID NO: 1284 - protein, 11 aa, Artificial Sequence
  Description of Artificial Sequence: Synthetic peptide
WFGSPSMYENL

SEQ ID NO: 1285 - protein, 11 aa, Artificial Sequence
  Description of Artificial Sequence: Synthetic peptide
WFGSPSMWENL

SEQ ID NO: 1286 - protein, 11 aa, Artificial Sequence
  Description of Artificial Sequence: Synthetic peptide
WFGSPSFPENL

SEQ ID NO: 1287 - protein, 11 aa, Artificial Sequence
  Description of Artificial Sequence: Synthetic peptide
WFGSPSFFENL

SEQ ID NO: 1288 - protein, 11 aa, Artificial Sequence
  Description of Artificial Sequence: Synthetic peptide
WFGSPSFYENL

SEQ ID NO: 1289 - protein, 11 aa, Artificial Sequence
  Description of Artificial Sequence: Synthetic peptide
WFGSPSFWENL

SEQ ID NO: 1290 - protein, 11 aa, Artificial Sequence
  Description of Artificial Sequence: Synthetic peptide
WFGSPSYPENL

SEQ ID NO: 1291 - protein, 11 aa, Artificial Sequence
  Description of Artificial Sequence: Synthetic peptide
WFGSPSYFENL

SEQ ID NO: 1292 - protein, 11 aa, Artificial Sequence
  Description of Artificial Sequence: Synthetic peptide
WFGSPSYYENL

SEQ ID NO: 1293 - protein, 11 aa, Artificial Sequence
  Description of Artificial Sequence: Synthetic peptide
WFGSPSYWENL

SEQ ID NO: 1294 - protein, 11 aa, Artificial Sequence
  Description of Artificial Sequence: Synthetic peptide
WFGSPSDPENL

SEQ ID NO: 1295 - protein, 11 aa, Artificial Sequence
  Description of Artificial Sequence: Synthetic peptide
WFGSPSDFENL

SEQ ID NO: 1296 - protein, 11 aa, Artificial Sequence
  Description of Artificial Sequence: Synthetic peptide
WFGSPSDYENL

SEQ ID NO: 1297 - protein, 11 aa, Artificial Sequence
  Description of Artificial Sequence: Synthetic peptide
WFGSPSDWENL

SEQ ID NO: 1298 - protein, 11 aa, Artificial Sequence
  Description of Artificial Sequence: Synthetic peptide
WFGSPSEPENL

SEQ ID NO: 1299 - protein, 11 aa, Artificial Sequence
  Description of Artificial Sequence: Synthetic peptide
WFGSPSEFENL

SEQ ID NO: 1300 - protein, 11 aa, Artificial Sequence
  Description of Artificial Sequence: Synthetic peptide
WFGSPSEYENL

SEQ ID NO: 1301 - protein, 11 aa, Artificial Sequence
  Description of Artificial Sequence: Synthetic peptide
WFGSPSEWENL

SEQ ID NO: 1302 - protein, 11 aa, Artificial Sequence
  Description of Artificial Sequence: Synthetic peptide
WFGSPSNPENL

SEQ ID NO: 1303 - protein, 11 aa, Artificial Sequence
  Description of Artificial Sequence: Synthetic peptide
WFGSPSNFENL

SEQ ID NO: 1304 - protein, 11 aa, Artificial Sequence
  Description of Artificial Sequence: Synthetic peptide
WFGSPSNYENL

SEQ ID NO: 1305 - protein, 11 aa, Artificial Sequence
  Description of Artificial Sequence: Synthetic peptide
WFGSPSNWENL

SEQ ID NO: 1306 - protein, 11 aa, Artificial Sequence
  Description of Artificial Sequence: Synthetic peptide
WFGSPSQPENL

SEQ ID NO: 1307 - protein, 11 aa, Artificial Sequence
  Description of Artificial Sequence: Synthetic peptide
WFGSPSQFENL

SEQ ID NO: 1308 - protein, 11 aa, Artificial Sequence
  Description of Artificial Sequence: Synthetic peptide
WFGSPSQYENL

SEQ ID NO: 1309 - protein, 11 aa, Artificial Sequence
  Description of Artificial Sequence: Synthetic peptide
WFGSPSQWENL

SEQ ID NO: 1310 - protein, 11 aa, Artificial Sequence
  Description of Artificial Sequence: Synthetic peptide
WFGSPSHPENL

SEQ ID NO: 1311 - protein, 11 aa, Artificial Sequence
  Description of Artificial Sequence: Synthetic peptide
WFGSPSHFENL

SEQ ID NO: 1312 - protein, 11 aa, Artificial Sequence
  Description of Artificial Sequence: Synthetic peptide
WFGSPSHYENL

SEQ ID NO: 1313 - protein, 11 aa, Artificial Sequence
  Description of Artificial Sequence: Synthetic peptide
WFGSPSHWENL

SEQ ID NO: 1314 - protein, 11 aa, Artificial Sequence
  Description of Artificial Sequence: Synthetic peptide
WFASPSMPENL

SEQ ID NO: 1315 - protein, 11 aa, Artificial Sequence
  Description of Artificial Sequence: Synthetic peptide
WFASPSMFENL

SEQ ID NO: 1316 - protein, 11 aa, Artificial Sequence
  Description of Artificial Sequence: Synthetic peptide
WFASPSMYENL

SEQ ID NO: 1317 - protein, 11 aa, Artificial Sequence
  Description of Artificial Sequence: Synthetic peptide
WFASPSMWENL

SEQ ID NO: 1318 - protein, 11 aa, Artificial Sequence
  Description of Artificial Sequence: Synthetic peptide
WFASPSFPENL

SEQ ID NO: 1319 - protein, 11 aa, Artificial Sequence
  Description of Artificial Sequence: Synthetic peptide
WFASPSFFENL

SEQ ID NO: 1320 - protein, 11 aa, Artificial Sequence
  Description of Artificial Sequence: Synthetic peptide
WFASPSFYENL

SEQ ID NO: 1321 - protein, 11 aa, Artificial Sequence
  Description of Artificial Sequence: Synthetic peptide
WFASPSFWENL

SEQ ID NO: 1322 - protein, 11 aa, Artificial Sequence
  Description of Artificial Sequence: Synthetic peptide
WFASPSYPENL

SEQ ID NO: 1323 - protein, 11 aa, Artificial Sequence
  Description of Artificial Sequence: Synthetic peptide
WFASPSYFENL

SEQ ID NO: 1324 - protein, 11 aa, Artificial Sequence
  Description of Artificial Sequence: Synthetic peptide
WFASPSYYENL

SEQ ID NO: 1325 - protein, 11 aa, Artificial Sequence
  Description of Artificial Sequence: Synthetic peptide
WFASPSYWENL

SEQ ID NO: 1326 - protein, 11 aa, Artificial Sequence
  Description of Artificial Sequence: Synthetic peptide
WFASPSDPENL

SEQ ID NO: 1327 - protein, 11 aa, Artificial Sequence
  Description of Artificial Sequence: Synthetic peptide
WFASPSDFENL

SEQ ID NO: 1328 - protein, 11 aa, Artificial Sequence
  Description of Artificial Sequence: Synthetic peptide
WFASPSDYENL

SEQ ID NO: 1329 - protein, 11 aa, Artificial Sequence
  Description of Artificial Sequence: Synthetic peptide
WFASPSDWENL

SEQ ID NO: 1330 - protein, 11 aa, Artificial Sequence
  Description of Artificial Sequence: Synthetic peptide
WFASPSEPENL

SEQ ID NO: 1331 - protein, 11 aa, Artificial Sequence
  Description of Artificial Sequence: Synthetic peptide
WFASPSEFENL

SEQ ID NO: 1332 - protein, 11 aa, Artificial Sequence
  Description of Artificial Sequence: Synthetic peptide
WFASPSEYENL

SEQ ID NO: 1333 - protein, 11 aa, Artificial Sequence
  Description of Artificial Sequence: Synthetic peptide
WFASPSEWENL

SEQ ID NO: 1334 - protein, 11 aa, Artificial Sequence
  Description of Artificial Sequence: Synthetic peptide
WFASPSNPENL

SEQ ID NO: 1335 - protein, 11 aa, Artificial Sequence
  Description of Artificial Sequence: Synthetic peptide
WFASPSNFENL

SEQ ID NO: 1336 - protein, 11 aa, Artificial Sequence
  Description of Artificial Sequence: Synthetic peptide
WFASPSNYENL

SEQ ID NO: 1337 - protein, 11 aa, Artificial Sequence
  Description of Artificial Sequence: Synthetic peptide
WFASPSNWENL

SEQ ID NO: 1338 - protein, 11 aa, Artificial Sequence
  Description of Artificial Sequence: Synthetic peptide
WFASPSQPENL

SEQ ID NO: 1339 - protein, 11 aa, Artificial Sequence
  Description of Artificial Sequence: Synthetic peptide
WFASPSQFENL

SEQ ID NO: 1340 - protein, 11 aa, Artificial Sequence
  Description of Artificial Sequence: Synthetic peptide
WFASPSQYENL

SEQ ID NO: 1341 - protein, 11 aa, Artificial Sequence
  Description of Artificial Sequence: Synthetic peptide
WFASPSQWENL

SEQ ID NO: 1342 - protein, 11 aa, Artificial Sequence
  Description of Artificial Sequence: Synthetic peptide
WFASPSHPENL

SEQ ID NO: 1343 - protein, 11 aa, Artificial Sequence
  Description of Artificial Sequence: Synthetic peptide
WFASPSHFENL

SEQ ID NO: 1344 - protein, 11 aa, Artificial Sequence
  Description of Artificial Sequence: Synthetic peptide
WFASPSHYENL

SEQ ID NO: 1345 - protein, 11 aa, Artificial Sequence
  Description of Artificial Sequence: Synthetic peptide
WFASPSHWENL

SEQ ID NO: 1346 - protein, 11 aa, Artificial Sequence
  Description of Artificial Sequence: Synthetic peptide
MYRSPSMPENL

SEQ ID NO: 1347 - protein, 11 aa, Artificial Sequence
  Description of Artificial Sequence: Synthetic peptide
MYRSPSMFENL

SEQ ID NO: 1348 - protein, 11 aa, Artificial Sequence
  Description of Artificial Sequence: Synthetic peptide
MYRSPSMYENL

SEQ ID NO: 1349 - protein, 11 aa, Artificial Sequence
  Description of Artificial Sequence: Synthetic peptide
MYRSPSMWENL

SEQ ID NO: 1350 - protein, 11 aa, Artificial Sequence
  Description of Artificial Sequence: Synthetic peptide
MYRSPSFPENL

SEQ ID NO: 1351 - protein, 11 aa, Artificial Sequence
  Description of Artificial Sequence: Synthetic peptide
MYRSPSFFENL

SEQ ID NO: 1352 - protein, 11 aa, Artificial Sequence
  Description of Artificial Sequence: Synthetic peptide
MYRSPSFYENL

SEQ ID NO: 1353 - protein, 11 aa, Artificial Sequence
  Description of Artificial Sequence: Synthetic peptide
MYRSPSFWENL

SEQ ID NO: 1354 - protein, 11 aa, Artificial Sequence
  Description of Artificial Sequence: Synthetic peptide
MYRSPSYPENL

SEQ ID NO: 1355 - protein, 11 aa, Artificial Sequence
  Description of Artificial Sequence: Synthetic peptide
MYRSPSYFENL

SEQ ID NO: 1356 - protein, 11 aa, Artificial Sequence
  Description of Artificial Sequence: Synthetic peptide
MYRSPSYYENL

SEQ ID NO: 1357 - protein, 11 aa, Artificial Sequence
  Description of Artificial Sequence: Synthetic peptide
MYRSPSYWENL

SEQ ID NO: 1358 - protein, 11 aa, Artificial Sequence
  Description of Artificial Sequence: Synthetic peptide
MYRSPSDPENL

SEQ ID NO: 1359 - protein, 11 aa, Artificial Sequence
  Description of Artificial Sequence: Synthetic peptide
MYRSPSDFENL

SEQ ID NO: 1360 - protein, 11 aa, Artificial Sequence
  Description of Artificial Sequence: Synthetic peptide
MYRSPSDYENL

SEQ ID NO: 1361 - protein, 11 aa, Artificial Sequence
  Description of Artificial Sequence: Synthetic peptide
MYRSPSDWENL

SEQ ID NO: 1362 - protein, 11 aa, Artificial Sequence
  Description of Artificial Sequence: Synthetic peptide
MYRSPSEPENL

SEQ ID NO: 1363 - protein, 11 aa, Artificial Sequence
  Description of Artificial Sequence: Synthetic peptide
MYRSPSEFENL

SEQ ID NO: 1364 - protein, 11 aa, Artificial Sequence
  Description of Artificial Sequence: Synthetic peptide
MYRSPSEYENL

SEQ ID NO: 1365 - protein, 11 aa, Artificial Sequence
  Description of Artificial Sequence: Synthetic peptide
MYRSPSEWENL

SEQ ID NO: 1366 - protein, 11 aa, Artificial Sequence
  Description of Artificial Sequence: Synthetic peptide
MYRSPSNPENL

SEQ ID NO: 1367 - protein, 11 aa, Artificial Sequence
  Description of Artificial Sequence: Synthetic peptide
MYRSPSNFENL

SEQ ID NO: 1368 - protein, 11 aa, Artificial Sequence
  Description of Artificial Sequence: Synthetic peptide
MYRSPSNYENL

SEQ ID NO: 1369 - protein, 11 aa, Artificial Sequence
  Description of Artificial Sequence: Synthetic peptide
MYRSPSNWENL

SEQ ID NO: 1370 - protein, 11 aa, Artificial Sequence
  Description of Artificial Sequence: Synthetic peptide
MYRSPSQPENL

SEQ ID NO: 1371 - protein, 11 aa, Artificial Sequence
  Description of Artificial Sequence: Synthetic peptide
MYRSPSQFENL

SEQ ID NO: 1372 - protein, 11 aa, Artificial Sequence
  Description of Artificial Sequence: Synthetic peptide
MYRSPSQYENL

SEQ ID NO: 1373 - protein, 11 aa, Artificial Sequence
  Description of Artificial Sequence: Synthetic peptide
MYRSPSQWENL

SEQ ID NO: 1374 - protein, 11 aa, Artificial Sequence
  Description of Artificial Sequence: Synthetic peptide
MYRSPSHPENL

SEQ ID NO: 1375 - protein, 11 aa, Artificial Sequence
  Description of Artificial Sequence: Synthetic peptide
MYRSPSHFENL

SEQ ID NO: 1376 - protein, 11 aa, Artificial Sequence
  Description of Artificial Sequence: Synthetic peptide
MYRSPSHYENL

SEQ ID NO: 1377 - protein, 11 aa, Artificial Sequence
  Description of Artificial Sequence: Synthetic peptide
MYRSPSHWENL

SEQ ID NO: 1378 - protein, 11 aa, Artificial Sequence
  Description of Artificial Sequence: Synthetic peptide
MYSSPSMPENL

SEQ ID NO: 1379 - protein, 11 aa, Artificial Sequence
  Description of Artificial Sequence: Synthetic peptide
MYSSPSMFENL

SEQ ID NO: 1380 - protein, 11 aa, Artificial Sequence
  Description of Artificial Sequence: Synthetic peptide
MYSSPSMYENL

SEQ ID NO: 1381 - protein, 11 aa, Artificial Sequence
  Description of Artificial Sequence: Synthetic peptide
MYSSPSMWENL

SEQ ID NO: 1382 - protein, 11 aa, Artificial Sequence
  Description of Artificial Sequence: Synthetic peptide
MYSSPSFPENL

SEQ ID NO: 1383 - protein, 11 aa, Artificial Sequence
  Description of Artificial Sequence: Synthetic peptide
MYSSPSFFENL

SEQ ID NO: 1384 - protein, 11 aa, Artificial Sequence
  Description of Artificial Sequence: Synthetic peptide
MYSSPSFYENL

SEQ ID NO: 1385 - protein, 11 aa, Artificial Sequence
  Description of Artificial Sequence: Synthetic peptide
MYSSPSFWENL

SEQ ID NO: 1386 - protein, 11 aa, Artificial Sequence
  Description of Artificial Sequence: Synthetic peptide
MYSSPSYPENL

SEQ ID NO: 1387 - protein, 11 aa, Artificial Sequence
  Description of Artificial Sequence: Synthetic peptide
MYSSPSYFENL

SEQ ID NO: 1388 - protein, 11 aa, Artificial Sequence
  Description of Artificial Sequence: Synthetic peptide
MYSSPSYYENL

SEQ ID NO: 1389 - protein, 11 aa, Artificial Sequence
  Description of Artificial Sequence: Synthetic peptide
MYSSPSYWENL

SEQ ID NO: 1390 - protein, 11 aa, Artificial Sequence
  Description of Artificial Sequence: Synthetic peptide
MYSSPSDPENL

SEQ ID NO: 1391 - protein, 11 aa, Artificial Sequence
  Description of Artificial Sequence: Synthetic peptide
MYSSPSDFENL

SEQ ID NO: 1392 - protein, 11 aa, Artificial Sequence
  Description of Artificial Sequence: Synthetic peptide
MYSSPSDYENL

SEQ ID NO: 1393 - protein, 11 aa, Artificial Sequence
  Description of Artificial Sequence: Synthetic peptide
MYSSPSDWENL

SEQ ID NO: 1394 - protein, 11 aa, Artificial Sequence
  Description of Artificial Sequence: Synthetic peptide
MYSSPSEPENL

SEQ ID NO: 1395 - protein, 11 aa, Artificial Sequence
  Description of Artificial Sequence: Synthetic peptide
MYSSPSEFENL

SEQ ID NO: 1396 - protein, 11 aa, Artificial Sequence
  Description of Artificial Sequence: Synthetic peptide
MYSSPSEYENL

SEQ ID NO: 1397 - protein, 11 aa, Artificial Sequence
  Description of Artificial Sequence: Synthetic peptide
MYSSPSEWENL

SEQ ID NO: 1398 - protein, 11 aa, Artificial Sequence
  Description of Artificial Sequence: Synthetic peptide
MYSSPSNPENL

SEQ ID NO: 1399 - protein, 11 aa, Artificial Sequence
  Description of Artificial Sequence: Synthetic peptide
MYSSPSNFENL

SEQ ID NO: 1400 - protein, 11 aa, Artificial Sequence
  Description of Artificial Sequence: Synthetic peptide
MYSSPSNYENL

SEQ ID NO: 1401 - protein, 11 aa, Artificial Sequence
  Description of Artificial Sequence: Synthetic peptide
MYSSPSNWENL

SEQ ID NO: 1402 - protein, 11 aa, Artificial Sequence
  Description of Artificial Sequence: Synthetic peptide
MYSSPSQPENL

SEQ ID NO: 1403 - protein, 11 aa, Artificial Sequence
  Description of Artificial Sequence: Synthetic peptide
MYSSPSQFENL

SEQ ID NO: 1404 - protein, 11 aa, Artificial Sequence
  Description of Artificial Sequence: Synthetic peptide
MYSSPSQYENL

SEQ ID NO: 1405 - protein, 11 aa, Artificial Sequence
  Description of Artificial Sequence: Synthetic peptide
MYSSPSQWENL

SEQ ID NO: 1406 - protein, 11 aa, Artificial Sequence
  Description of Artificial Sequence: Synthetic peptide
MYSSPSHPENL

SEQ ID NO: 1407 - protein, 11 aa, Artificial Sequence
  Description of Artificial Sequence: Synthetic peptide
MYSSPSHFENL

SEQ ID NO: 1408 - protein, 11 aa, Artificial Sequence
  Description of Artificial Sequence: Synthetic peptide
MYSSPSHYENL

SEQ ID NO: 1409 - protein, 11 aa, Artificial Sequence
  Description of Artificial Sequence: Synthetic peptide
MYSSPSHWENL

SEQ ID NO: 1410 - protein, 11 aa, Artificial Sequence
  Description of Artificial Sequence: Synthetic peptide
MYTSPSMPENL

SEQ ID NO: 1411 - protein, 11 aa, Artificial Sequence
  Description of Artificial Sequence: Synthetic peptide
MYTSPSMFENL

SEQ ID NO: 1412 - protein, 11 aa, Artificial Sequence
  Description of Artificial Sequence: Synthetic peptide
MYTSPSMYENL

SEQ ID NO: 1413 - protein, 11 aa, Artificial Sequence
  Description of Artificial Sequence: Synthetic peptide
MYTSPSMWENL

SEQ ID NO: 1414 - protein, 11 aa, Artificial Sequence
  Description of Artificial Sequence: Synthetic peptide
MYTSPSFPENL

SEQ ID NO: 1415 - protein, 11 aa, Artificial Sequence
  Description of Artificial Sequence: Synthetic peptide
MYTSPSFFENL

SEQ ID NO: 1416 - protein, 11 aa, Artificial Sequence
  Description of Artificial Sequence: Synthetic peptide
MYTSPSFYENL

SEQ ID NO: 1417 - protein, 11 aa, Artificial Sequence
  Description of Artificial Sequence: Synthetic peptide
MYTSPSFWENL

SEQ ID NO: 1418 - protein, 11 aa, Artificial Sequence
  Description of Artificial Sequence: Synthetic peptide
MYTSPSYPENL

SEQ ID NO: 1419 - protein, 11 aa, Artificial Sequence
  Description of Artificial Sequence: Synthetic peptide
MYTSPSYFENL

SEQ ID NO: 1420 - protein, 11 aa, Artificial Sequence
  Description of Artificial Sequence: Synthetic peptide
MYTSPSYYENL

SEQ ID NO: 1421 - protein, 11 aa, Artificial Sequence
  Description of Artificial Sequence: Synthetic peptide
MYTSPSYWENL

SEQ ID NO: 1422 - protein, 11 aa, Artificial Sequence
  Description of Artificial Sequence: Synthetic peptide
MYTSPSDPENL

SEQ ID NO: 1423 - protein, 11 aa, Artificial Sequence
  Description of Artificial Sequence: Synthetic peptide
MYTSPSDFENL

SEQ ID NO: 1424 - protein, 11 aa, Artificial Sequence
  Description of Artificial Sequence: Synthetic peptide
MYTSPSDYENL

SEQ ID NO: 1425 - protein, 11 aa, Artificial Sequence
  Description of Artificial Sequence: Synthetic peptide
MYTSPSDWENL

SEQ ID NO: 1426 - protein, 11 aa, Artificial Sequence
  Description of Artificial Sequence: Synthetic peptide
MYTSPSEPENL

SEQ ID NO: 1427 - protein, 11 aa, Artificial Sequence
  Description of Artificial Sequence: Synthetic peptide
MYTSPSEFENL

SEQ ID NO: 1428 - protein, 11 aa, Artificial Sequence
  Description of Artificial Sequence: Synthetic peptide
MYTSPSEYENL

SEQ ID NO: 1429 - protein, 11 aa, Artificial Sequence
  Description of Artificial Sequence: Synthetic peptide
MYTSPSEWENL

SEQ ID NO: 1430 - protein, 11 aa, Artificial Sequence
  Description of Artificial Sequence: Synthetic peptide
MYTSPSNPENL

SEQ ID NO: 1431 - protein, 11 aa, Artificial Sequence
  Description of Artificial Sequence: Synthetic peptide
MYTSPSNFENL

SEQ ID NO: 1432 - protein, 11 aa, Artificial Sequence
  Description of Artificial Sequence: Synthetic peptide
MYTSPSNYENL

SEQ ID NO: 1433 - protein, 11 aa, Artificial Sequence
  Description of Artificial Sequence: Synthetic peptide
MYTSPSNWENL

SEQ ID NO: 1434 - protein, 11 aa, Artificial Sequence
  Description of Artificial Sequence: Synthetic peptide
MYTSPSQPENL

SEQ ID NO: 1435 - protein, 11 aa, Artificial Sequence
  Description of Artificial Sequence: Synthetic peptide
MYTSPSQFENL

SEQ ID NO: 1436 - protein, 11 aa, Artificial Sequence
  Description of Artificial Sequence: Synthetic peptide
MYTSPSQYENL

SEQ ID NO: 1437 - protein, 11 aa, Artificial Sequence
  Description of Artificial Sequence: Synthetic peptide
MYTSPSQWENL

SEQ ID NO: 1438 - protein, 11 aa, Artificial Sequence
  Description of Artificial Sequence: Synthetic peptide
MYTSPSHPENL

SEQ ID NO: 1439 - protein, 11 aa, Artificial Sequence
  Description of Artificial Sequence: Synthetic peptide
MYTSPSHFENL

SEQ ID NO: 1440 - protein, 11 aa, Artificial Sequence
  Description of Artificial Sequence: Synthetic peptide
MYTSPSHYENL

SEQ ID NO: 1441 - protein, 11 aa, Artificial Sequence
  Description of Artificial Sequence: Synthetic peptide
MYTSPSHWENL

SEQ ID NO: 1442 - protein, 11 aa, Artificial Sequence
  Description of Artificial Sequence: Synthetic peptide
MYHSPSMPENL

SEQ ID NO: 1443 - protein, 11 aa, Artificial Sequence
  Description of Artificial Sequence: Synthetic peptide
MYHSPSMFENL

SEQ ID NO: 1444 - protein, 11 aa, Artificial Sequence
  Description of Artificial Sequence: Synthetic peptide
MYHSPSMYENL

SEQ ID NO: 1445 - protein, 11 aa, Artificial Sequence
  Description of Artificial Sequence: Synthetic peptide
MYHSPSMWENL

SEQ ID NO: 1446 - protein, 11 aa, Artificial Sequence
  Description of Artificial Sequence: Synthetic peptide
MYHSPSFPENL

SEQ ID NO: 1447 - protein, 11 aa, Artificial Sequence
  Description of Artificial Sequence: Synthetic peptide
MYHSPSFFENL

SEQ ID NO: 1448 - protein, 11 aa, Artificial Sequence
  Description of Artificial Sequence: Synthetic peptide
MYHSPSFYENL

SEQ ID NO: 1449 - protein, 11 aa, Artificial Sequence
  Description of Artificial Sequence: Synthetic peptide
MYHSPSFWENL

SEQ ID NO: 1450 - protein, 11 aa, Artificial Sequence
  Description of Artificial Sequence: Synthetic peptide
MYHSPSYPENL

SEQ ID NO: 1451 - protein, 11 aa, Artificial Sequence
  Description of Artificial Sequence: Synthetic peptide
MYHSPSYFENL

SEQ ID NO: 1452 - protein, 11 aa, Artificial Sequence
  Description of Artificial Sequence: Synthetic peptide
MYHSPSYYENL

SEQ ID NO: 1453 - protein, 11 aa, Artificial Sequence
  Description of Artificial Sequence: Synthetic peptide
MYHSPSYWENL

SEQ ID NO: 1454 - protein, 11 aa, Artificial Sequence
  Description of Artificial Sequence: Synthetic peptide
MYHSPSDPENL

SEQ ID NO: 1455 - protein, 11 aa, Artificial Sequence
  Description of Artificial Sequence: Synthetic peptide
MYHSPSDFENL

SEQ ID NO: 1456 - protein, 11 aa, Artificial Sequence
  Description of Artificial Sequence: Synthetic peptide
MYHSPSDYENL

SEQ ID NO: 1457 - protein, 11 aa, Artificial Sequence
  Description of Artificial Sequence: Synthetic peptide
MYHSPSDWENL

SEQ ID NO: 1458 - protein, 11 aa, Artificial Sequence
  Description of Artificial Sequence: Synthetic peptide
MYHSPSEPENL

SEQ ID NO: 1459 - protein, 11 aa, Artificial Sequence
  Description of Artificial Sequence: Synthetic peptide
MYHSPSEFENL

SEQ ID NO: 1460 - protein, 11 aa, Artificial Sequence
  Description of Artificial Sequence: Synthetic peptide
MYHSPSEYENL

SEQ ID NO: 1461 - protein, 11 aa, Artificial Sequence
  Description of Artificial Sequence: Synthetic peptide
MYHSPSEWENL

SEQ ID NO: 1462 - protein, 11 aa, Artificial Sequence
  Description of Artificial Sequence: Synthetic peptide
MYHSPSNPENL

SEQ ID NO: 1463 - protein, 11 aa, Artificial Sequence
  Description of Artificial Sequence: Synthetic peptide
MYHSPSNFENL

SEQ ID NO: 1464 - protein, 11 aa, Artificial Sequence
  Description of Artificial Sequence: Synthetic peptide
MYHSPSNYENL

SEQ ID NO: 1465 - protein, 11 aa, Artificial Sequence
  Description of Artificial Sequence: Synthetic peptide
MYHSPSNWENL

SEQ ID NO: 1466 - protein, 11 aa, Artificial Sequence
  Description of Artificial Sequence: Synthetic peptide
MYHSPSQPENL

SEQ ID NO: 1467 - protein, 11 aa, Artificial Sequence
  Description of Artificial Sequence: Synthetic peptide
MYHSPSQFENL

SEQ ID NO: 1468 - protein, 11 aa, Artificial Sequence
  Description of Artificial Sequence: Synthetic peptide
MYHSPSQYENL

SEQ ID NO: 1469 - protein, 11 aa, Artificial Sequence
  Description of Artificial Sequence: Synthetic peptide
MYHSPSQWENL

SEQ ID NO: 1470 - protein, 11 aa, Artificial Sequence
  Description of Artificial Sequence: Synthetic peptide
MYHSPSHPENL

SEQ ID NO: 1471 - protein, 11 aa, Artificial Sequence
  Description of Artificial Sequence: Synthetic peptide
MYHSPSHFENL

SEQ ID NO: 1472 - protein, 11 aa, Artificial Sequence
  Description of Artificial Sequence: Synthetic peptide
MYHSPSHYENL

SEQ ID NO: 1473 - protein, 11 aa, Artificial Sequence
  Description of Artificial Sequence: Synthetic peptide
MYHSPSHWENL

SEQ ID NO: 1474 - protein, 11 aa, Artificial Sequence
  Description of Artificial Sequence: Synthetic peptide
MYNSPSMPENL

SEQ ID NO: 1475 - protein, 11 aa, Artificial Sequence
  Description of Artificial Sequence: Synthetic peptide
MYNSPSMFENL

SEQ ID NO: 1476 - protein, 11 aa, Artificial Sequence
  Description of Artificial Sequence: Synthetic peptide
MYNSPSMYENL

SEQ ID NO: 1477 - protein, 11 aa, Artificial Sequence
  Description of Artificial Sequence: Synthetic peptide
MYNSPSMWENL

SEQ ID NO: 1478 - protein, 11 aa, Artificial Sequence
  Description of Artificial Sequence: Synthetic peptide
MYNSPSFPENL

SEQ ID NO: 1479 - protein, 11 aa, Artificial Sequence
  Description of Artificial Sequence: Synthetic peptide
MYNSPSFFENL

SEQ ID NO: 1480 - protein, 11 aa, Artificial Sequence
  Description of Artificial Sequence: Synthetic peptide
MYNSPSFYENL

SEQ ID NO: 1481 - protein, 11 aa, Artificial Sequence
  Description of Artificial Sequence: Synthetic peptide
MYNSPSFWENL

SEQ ID NO: 1482 - protein, 11 aa, Artificial Sequence
  Description of Artificial Sequence: Synthetic peptide
MYNSPSYPENL

SEQ ID NO: 1483 - protein, 11 aa, Artificial Sequence
  Description of Artificial Sequence: Synthetic peptide
MYNSPSYFENL

SEQ ID NO: 1484 - protein, 11 aa, Artificial Sequence
  Description of Artificial Sequence: Synthetic peptide
MYNSPSYYENL

SEQ ID NO: 1485 - protein, 11 aa, Artificial Sequence
  Description of Artificial Sequence: Synthetic peptide
MYNSPSYWENL

SEQ ID NO: 1486 - protein, 11 aa, Artificial Sequence
  Description of Artificial Sequence: Synthetic peptide
MYNSPSDPENL

SEQ ID NO: 1487 - protein, 11 aa, Artificial Sequence
  Description of Artificial Sequence: Synthetic peptide
MYNSPSDFENL

SEQ ID NO: 1488 - protein, 11 aa, Artificial Sequence
  Description of Artificial Sequence: Synthetic peptide
MYNSPSDYENL

SEQ ID NO: 1489 - protein, 11 aa, Artificial Sequence
  Description of Artificial Sequence: Synthetic peptide
MYNSPSDWENL

SEQ ID NO: 1490 - protein, 11 aa, Artificial Sequence
  Description of Artificial Sequence: Synthetic peptide
MYNSPSEPENL

SEQ ID NO: 1491 - protein, 11 aa, Artificial Sequence
  Description of Artificial Sequence: Synthetic peptide
MYNSPSEFENL

SEQ ID NO: 1492 - protein, 11 aa, Artificial Sequence
  Description of Artificial Sequence: Synthetic peptide
MYNSPSEYENL

SEQ ID NO: 1493 - protein, 11 aa, Artificial Sequence
  Description of Artificial Sequence: Synthetic peptide
MYNSPSEWENL

SEQ ID NO: 1494 - protein, 11 aa, Artificial Sequence
  Description of Artificial Sequence: Synthetic peptide
MYNSPSNPENL

SEQ ID NO: 1495 - protein, 11 aa, Artificial Sequence
  Description of Artificial Sequence: Synthetic peptide
MYNSPSNFENL

SEQ ID NO: 1496 - protein, 11 aa, Artificial Sequence
  Description of Artificial Sequence: Synthetic peptide
MYNSPSNYENL

SEQ ID NO: 1497 - protein, 11 aa, Artificial Sequence
  Description of Artificial Sequence: Synthetic peptide
MYNSPSNWENL

SEQ ID NO: 1498 - protein, 11 aa, Artificial Sequence
  Description of Artificial Sequence: Synthetic peptide
MYNSPSQPENL

SEQ ID NO: 1499 - protein, 11 aa, Artificial Sequence
  Description of Artificial Sequence: Synthetic peptide
MYNSPSQFENL

SEQ ID NO: 1500 - protein, 11 aa, Artificial Sequence
  Description of Artificial Sequence: Synthetic peptide
MYNSPSQYENL

SEQ ID NO: 1501 - protein, 11 aa, Artificial Sequence
  Description of Artificial Sequence: Synthetic peptide
MYNSPSQWENL

SEQ ID NO: 1502 - protein, 11 aa, Artificial Sequence
  Description of Artificial Sequence: Synthetic peptide
MYNSPSHPENL

SEQ ID NO: 1503 - protein, 11 aa, Artificial Sequence
  Description of Artificial Sequence: Synthetic peptide
MYNSPSHFENL

SEQ ID NO: 1504 - protein, 11 aa, Artificial Sequence
  Description of Artificial Sequence: Synthetic peptide
MYNSPSHYENL

SEQ ID NO: 1505 - protein, 11 aa, Artificial Sequence
  Description of Artificial Sequence: Synthetic peptide
MYNSPSHWENL

SEQ ID NO: 1506 - protein, 11 aa, Artificial Sequence
  Description of Artificial Sequence: Synthetic peptide
MYGSPSMPENL

SEQ ID NO: 1507 - protein, 11 aa, Artificial Sequence
  Description of Artificial Sequence: Synthetic peptide
MYGSPSMFENL

SEQ ID NO: 1508 - protein, 11 aa, Artificial Sequence
  Description of Artificial Sequence: Synthetic peptide
MYGSPSMYENL

SEQ ID NO: 1509 - protein, 11 aa, Artificial Sequence
  Description of Artificial Sequence: Synthetic peptide
MYGSPSMWENL

SEQ ID NO: 1510 - protein, 11 aa, Artificial Sequence
  Description of Artificial Sequence: Synthetic peptide
MYGSPSFPENL

SEQ ID NO: 1511 - protein, 11 aa, Artificial Sequence
  Description of Artificial Sequence: Synthetic peptide
MYGSPSFFENL

SEQ ID NO: 1512 - protein, 11 aa, Artificial Sequence
  Description of Artificial Sequence: Synthetic peptide
MYGSPSFYENL

SEQ ID NO: 1513 - protein, 11 aa, Artificial Sequence
  Description of Artificial Sequence: Synthetic peptide
MYGSPSFWENL

SEQ ID NO: 1514 - protein, 11 aa, Artificial Sequence
  Description of Artificial Sequence: Synthetic peptide
MYGSPSYPENL

SEQ ID NO: 1515 - protein, 11 aa, Artificial Sequence
  Description of Artificial Sequence: Synthetic peptide
MYGSPSYFENL

SEQ ID NO: 1516 - protein, 11 aa, Artificial Sequence
  Description of Artificial Sequence: Synthetic peptide
MYGSPSYYENL

SEQ ID NO: 1517 - protein, 11 aa, Artificial Sequence
  Description of Artificial Sequence: Synthetic peptide
MYGSPSYWENL

SEQ ID NO: 1518 - protein, 11 aa, Artificial Sequence
  Description of Artificial Sequence: Synthetic peptide
MYGSPSDPENL

SEQ ID NO: 1519 - protein, 11 aa, Artificial Sequence
  Description of Artificial Sequence: Synthetic peptide
MYGSPSDFENL

SEQ ID NO: 1520 - protein, 11 aa, Artificial Sequence
  Description of Artificial Sequence: Synthetic peptide
MYGSPSDYENL

SEQ ID NO: 1521 - protein, 11 aa, Artificial Sequence
  Description of Artificial Sequence: Synthetic peptide
MYGSPSDWENL

SEQ ID NO: 1522 - protein, 11 aa, Artificial Sequence
  Description of Artificial Sequence: Synthetic peptide
MYGSPSEPENL

SEQ ID NO: 1523 - protein, 11 aa, Artificial Sequence
  Description of Artificial Sequence: Synthetic peptide
MYGSPSEFENL

SEQ ID NO: 1524 - protein, 11 aa, Artificial Sequence
  Description of Artificial Sequence: Synthetic peptide
MYGSPSEYENL

SEQ ID NO: 1525 - protein, 11 aa, Artificial Sequence
  Description of Artificial Sequence: Synthetic peptide
MYGSPSEWENL

SEQ ID NO: 1526 - protein, 11 aa, Artificial Sequence
  Description of Artificial Sequence: Synthetic peptide
MYGSPSNPENL

SEQ ID NO: 1527 - protein, 11 aa, Artificial Sequence
  Description of Artificial Sequence: Synthetic peptide
MYGSPSNFENL

SEQ ID NO: 1528 - protein, 11 aa, Artificial Sequence
  Description of Artificial Sequence: Synthetic peptide
MYGSPSNYENL

SEQ ID NO: 1529 - protein, 11 aa, Artificial Sequence
  Description of Artificial Sequence: Synthetic peptide
MYGSPSNWENL

SEQ ID NO: 1530 - protein, 11 aa, Artificial Sequence
  Description of Artificial Sequence: Synthetic peptide
MYGSPSQPENL

SEQ ID NO: 1531 - protein, 11 aa, Artificial Sequence
  Description of Artificial Sequence: Synthetic peptide
MYGSPSQFENL

SEQ ID NO: 1532 - protein, 11 aa, Artificial Sequence
  Description of Artificial Sequence: Synthetic peptide
MYGSPSQYENL

SEQ ID NO: 1533 - protein, 11 aa, Artificial Sequence
  Description of Artificial Sequence: Synthetic peptide
MYGSPSQWENL

SEQ ID NO: 1534 - protein, 11 aa, Artificial Sequence
  Description of Artificial Sequence: Synthetic peptide
MYGSPSHPENL

SEQ ID NO: 1535 - protein, 11 aa, Artificial Sequence
  Description of Artificial Sequence: Synthetic peptide
MYGSPSHFENL

SEQ ID NO: 1536 - protein, 11 aa, Artificial Sequence
  Description of Artificial Sequence: Synthetic peptide
MYGSPSHYENL

SEQ ID NO: 1537 - protein, 11 aa, Artificial Sequence
  Description of Artificial Sequence: Synthetic peptide
MYGSPSHWENL

SEQ ID NO: 1538 - protein, 11 aa, Artificial Sequence
  Description of Artificial Sequence: Synthetic peptide
MYASPSMPENL

SEQ ID NO: 1539 - protein, 11 aa, Artificial Sequence
  Description of Artificial Sequence: Synthetic peptide
MYASPSMFENL

SEQ ID NO: 1540 - protein, 11 aa, Artificial Sequence
  Description of Artificial Sequence: Synthetic peptide
MYASPSMYENL

SEQ ID NO: 1541 - protein, 11 aa, Artificial Sequence
  Description of Artificial Sequence: Synthetic peptide
MYASPSMWENL

SEQ ID NO: 1542 - protein, 11 aa, Artificial Sequence
  Description of Artificial Sequence: Synthetic peptide
MYASPSFPENL

SEQ ID NO: 1543 - protein, 11 aa, Artificial Sequence
  Description of Artificial Sequence: Synthetic peptide
MYASPSFFENL

SEQ ID NO: 1544 - protein, 11 aa, Artificial Sequence
  Description of Artificial Sequence: Synthetic peptide
MYASPSFYENL

SEQ ID NO: 1545 - protein, 11 aa, Artificial Sequence
  Description of Artificial Sequence: Synthetic peptide
MYASPSFWENL

SEQ ID NO: 1546 - protein, 11 aa, Artificial Sequence
  Description of Artificial Sequence: Synthetic peptide
MYASPSYPENL

SEQ ID NO: 1547 - protein, 11 aa, Artificial Sequence
  Description of Artificial Sequence: Synthetic peptide
MYASPSYFENL

SEQ ID NO: 1548 - protein, 11 aa, Artificial Sequence
  Description of Artificial Sequence: Synthetic peptide
MYASPSYYENL

SEQ ID NO: 1549 - protein, 11 aa, Artificial Sequence
  Description of Artificial Sequence: Synthetic peptide
MYASPSYWENL

SEQ ID NO: 1550 - protein, 11 aa, Artificial Sequence
  Description of Artificial Sequence: Synthetic peptide
MYASPSDPENL

SEQ ID NO: 1551 - protein, 11 aa, Artificial Sequence
  Description of Artificial Sequence: Synthetic peptide
MYASPSDFENL

SEQ ID NO: 1552 - protein, 11 aa, Artificial Sequence
  Description of Artificial Sequence: Synthetic peptide
MYASPSDYENL

SEQ ID NO: 1553 - protein, 11 aa, Artificial Sequence
  Description of Artificial Sequence: Synthetic peptide
MYASPSDWENL

SEQ ID NO: 1554 - protein, 11 aa, Artificial Sequence
  Description of Artificial Sequence: Synthetic peptide
MYASPSEPENL

SEQ ID NO: 1555 - protein, 11 aa, Artificial Sequence
  Description of Artificial Sequence: Synthetic peptide
MYASPSEFENL

SEQ ID NO: 1556 - protein, 11 aa, Artificial Sequence
  Description of Artificial Sequence: Synthetic peptide
MYASPSEYENL

SEQ ID NO: 1557 - protein, 11 aa, Artificial Sequence
  Description of Artificial Sequence: Synthetic peptide
MYASPSEWENL

SEQ ID NO: 1558 - protein, 11 aa, Artificial Sequence
  Description of Artificial Sequence: Synthetic peptide
MYASPSNPENL

SEQ ID NO: 1559 - protein, 11 aa, Artificial Sequence
  Description of Artificial Sequence: Synthetic peptide
MYASPSNFENL

SEQ ID NO: 1560 - protein, 11 aa, Artificial Sequence
  Description of Artificial Sequence: Synthetic peptide
MYASPSNYENL

SEQ ID NO: 1561 - protein, 11 aa, Artificial Sequence
  Description of Artificial Sequence: Synthetic peptide
MYASPSNWENL

SEQ ID NO: 1562 - protein, 11 aa, Artificial Sequence
  Description of Artificial Sequence: Synthetic peptide
MYASPSQPENL

SEQ ID NO: 1563 - protein, 11 aa, Artificial Sequence
  Description of Artificial Sequence: Synthetic peptide
MYASPSQFENL

SEQ ID NO: 1564 - protein, 11 aa, Artificial Sequence
  Description of Artificial Sequence: Synthetic peptide
MYASPSQYENL

SEQ ID NO: 1565 - protein, 11 aa, Artificial Sequence
  Description of Artificial Sequence: Synthetic peptide
MYASPSQWENL

SEQ ID NO: 1566 - protein, 11 aa, Artificial Sequence
  Description of Artificial Sequence: Synthetic peptide
MYASPSHPENL

SEQ ID NO: 1567 - protein, 11 aa, Artificial Sequence
  Description of Artificial Sequence: Synthetic peptide
MYASPSHFENL

SEQ ID NO: 1568 - protein, 11 aa, Artificial Sequence
  Description of Artificial Sequence: Synthetic peptide
MYASPSHYENL

SEQ ID NO: 1569 - protein, 11 aa, Artificial Sequence
  Description of Artificial Sequence: Synthetic peptide
MYASPSHWENL

SEQ ID NO: 1570 - protein, 11 aa, Artificial Sequence
  Description of Artificial Sequence: Synthetic peptide
MFRSPSMPENL

SEQ ID NO: 1571 - protein, 11 aa, Artificial Sequence
  Description of Artificial Sequence: Synthetic peptide
MFRSPSMFENL

SEQ ID NO: 1572 - protein, 11 aa, Artificial Sequence
  Description of Artificial Sequence: Synthetic peptide
MFRSPSMYENL

SEQ ID NO: 1573 - protein, 11 aa, Artificial Sequence
  Description of Artificial Sequence: Synthetic peptide
MFRSPSMWENL

SEQ ID NO: 1574 - protein, 11 aa, Artificial Sequence
  Description of Artificial Sequence: Synthetic peptide
MFRSPSFPENL

SEQ ID NO: 1575 - protein, 11 aa, Artificial Sequence
  Description of Artificial Sequence: Synthetic peptide
MFRSPSFFENL

SEQ ID NO: 1576 - protein, 11 aa, Artificial Sequence
  Description of Artificial Sequence: Synthetic peptide
MFRSPSFYENL

SEQ ID NO: 1577 - protein, 11 aa, Artificial Sequence
  Description of Artificial Sequence: Synthetic peptide
MFRSPSFWENL

SEQ ID NO: 1578 - protein, 11 aa, Artificial Sequence
  Description of Artificial Sequence: Synthetic peptide
MFRSPSYPENL

SEQ ID NO: 1579 - protein, 11 aa, Artificial Sequence
  Description of Artificial Sequence: Synthetic peptide
MFRSPSYFENL

SEQ ID NO: 1580 - protein, 11 aa, Artificial Sequence
  Description of Artificial Sequence: Synthetic peptide
MFRSPSYYENL

SEQ ID NO: 1581 - protein, 11 aa, Artificial Sequence
  Description of Artificial Sequence: Synthetic peptide
MFRSPSYWENL

SEQ ID NO: 1582 - protein, 11 aa, Artificial Sequence
  Description of Artificial Sequence: Synthetic peptide
MFRSPSDPENL

SEQ ID NO: 1583 - protein, 11 aa, Artificial Sequence
  Description of Artificial Sequence: Synthetic peptide
MFRSPSDFENL

SEQ ID NO: 1584 - protein, 11 aa, Artificial Sequence
  Description of Artificial Sequence: Synthetic peptide
MFRSPSDYENL

SEQ ID NO: 1585 - protein, 11 aa, Artificial Sequence
  Description of Artificial Sequence: Synthetic peptide
MFRSPSDWENL

SEQ ID NO: 1586 - protein, 11 aa, Artificial Sequence
  Description of Artificial Sequence: Synthetic peptide
MFRSPSEPENL

SEQ ID NO: 1587 - protein, 11 aa, Artificial Sequence
  Description of Artificial Sequence: Synthetic peptide
MFRSPSEFENL

SEQ ID NO: 1588 - protein, 11 aa, Artificial Sequence
  Description of Artificial Sequence: Synthetic peptide
MFRSPSEYENL

SEQ ID NO: 1589 - protein, 11 aa, Artificial Sequence
  Description of Artificial Sequence: Synthetic peptide
MFRSPSEWENL

SEQ ID NO: 1590 - protein, 11 aa, Artificial Sequence
  Description of Artificial Sequence: Synthetic peptide
MFRSPSNPENL

SEQ ID NO: 1591 - protein, 11 aa, Artificial Sequence
  Description of Artificial Sequence: Synthetic peptide
MFRSPSNFENL

SEQ ID NO: 1592 - protein, 11 aa, Artificial Sequence
  Description of Artificial Sequence: Synthetic peptide
MFRSPSNYENL

SEQ ID NO: 1593 - protein, 11 aa, Artificial Sequence
  Description of Artificial Sequence: Synthetic peptide
MFRSPSNWENL

SEQ ID NO: 1594 - protein, 11 aa, Artificial Sequence
  Description of Artificial Sequence: Synthetic peptide
MFRSPSQPENL

SEQ ID NO: 1595 - protein, 11 aa, Artificial Sequence
  Description of Artificial Sequence: Synthetic peptide
MFRSPSQFENL

SEQ ID NO: 1596 - protein, 11 aa, Artificial Sequence
  Description of Artificial Sequence: Synthetic peptide
MFRSPSQYENL

SEQ ID NO: 1597 - protein, 11 aa, Artificial Sequence
  Description of Artificial Sequence: Synthetic peptide
MFRSPSQWENL

SEQ ID NO: 1598 - protein, 11 aa, Artificial Sequence
  Description of Artificial Sequence: Synthetic peptide
MFRSPSHPENL

SEQ ID NO: 1599 - protein, 11 aa, Artificial Sequence
  Description of Artificial Sequence: Synthetic peptide
MFRSPSHFENL

SEQ ID NO: 1600 - protein, 11 aa, Artificial Sequence
  Description of Artificial Sequence: Synthetic peptide
MFRSPSHYENL

SEQ ID NO: 1601 - protein, 11 aa, Artificial Sequence
  Description of Artificial Sequence: Synthetic peptide
MFRSPSHWENL

SEQ ID NO: 1602 - protein, 11 aa, Artificial Sequence
  Description of Artificial Sequence: Synthetic peptide
MFSSPSMPENL

SEQ ID NO: 1603 - protein, 11 aa, Artificial Sequence
  Description of Artificial Sequence: Synthetic peptide
MFSSPSMFENL

SEQ ID NO: 1604 - protein, 11 aa, Artificial Sequence
  Description of Artificial Sequence: Synthetic peptide
MFSSPSMYENL

SEQ ID NO: 1605 - protein, 11 aa, Artificial Sequence
  Description of Artificial Sequence: Synthetic peptide
MFSSPSMWENL

SEQ ID NO: 1606 - protein, 11 aa, Artificial Sequence
  Description of Artificial Sequence: Synthetic peptide
MFSSPSFPENL

SEQ ID NO: 1607 - protein, 11 aa, Artificial Sequence
  Description of Artificial Sequence: Synthetic peptide
MFSSPSFFENL

SEQ ID NO: 1608 - protein, 11 aa, Artificial Sequence
  Description of Artificial Sequence: Synthetic peptide
MFSSPSFYENL

SEQ ID NO: 1609 - protein, 11 aa, Artificial Sequence
  Description of Artificial Sequence: Synthetic peptide
MFSSPSFWENL

SEQ ID NO: 1610 - protein, 11 aa, Artificial Sequence
  Description of Artificial Sequence: Synthetic peptide
MFSSPSYPENL

SEQ ID NO: 1611 - protein, 11 aa, Artificial Sequence
  Description of Artificial Sequence: Synthetic peptide
MFSSPSYFENL

SEQ ID NO: 1612 - protein, 11 aa, Artificial Sequence
  Description of Artificial Sequence: Synthetic peptide
MFSSPSYYENL

SEQ ID NO: 1613 - protein, 11 aa, Artificial Sequence
  Description of Artificial Sequence: Synthetic peptide
MFSSPSYWENL

SEQ ID NO: 1614 - protein, 11 aa, Artificial Sequence
  Description of Artificial Sequence: Synthetic peptide
MFSSPSDPENL

SEQ ID NO: 1615 - protein, 11 aa, Artificial Sequence
  Description of Artificial Sequence: Synthetic peptide
MFSSPSDFENL

SEQ ID NO: 1616 - protein, 11 aa, Artificial Sequence
  Description of Artificial Sequence: Synthetic peptide
MFSSPSDYENL

SEQ ID NO: 1617 - protein, 11 aa, Artificial Sequence
  Description of Artificial Sequence: Synthetic peptide
MFSSPSDWENL

SEQ ID NO: 1618 - protein, 11 aa, Artificial Sequence
  Description of Artificial Sequence: Synthetic peptide
MFSSPSEPENL

SEQ ID NO: 1619 - protein, 11 aa, Artificial Sequence
  Description of Artificial Sequence: Synthetic peptide
MFSSPSEFENL

SEQ ID NO: 1620 - protein, 11 aa, Artificial Sequence
  Description of Artificial Sequence: Synthetic peptide
MFSSPSEYENL

SEQ ID NO: 1621 - protein, 11 aa, Artificial Sequence
  Description of Artificial Sequence: Synthetic peptide
MFSSPSEWENL

SEQ ID NO: 1622 - protein, 11 aa, Artificial Sequence
  Description of Artificial Sequence: Synthetic peptide
MFSSPSNPENL

SEQ ID NO: 1623 - protein, 11 aa, Artificial Sequence
  Description of Artificial Sequence: Synthetic peptide
MFSSPSNFENL

SEQ ID NO: 1624 - protein, 11 aa, Artificial Sequence
  Description of Artificial Sequence: Synthetic peptide
MFSSPSNYENL

SEQ ID NO: 1625 - protein, 11 aa, Artificial Sequence
  Description of Artificial Sequence: Synthetic peptide
MFSSPSNWENL

SEQ ID NO: 1626 - protein, 11 aa, Artificial Sequence
  Description of Artificial Sequence: Synthetic peptide
MFSSPSQPENL

SEQ ID NO: 1627 - protein, 11 aa, Artificial Sequence
  Description of Artificial Sequence: Synthetic peptide
MFSSPSQFENL

SEQ ID NO: 1628 - protein, 11 aa, Artificial Sequence
  Description of Artificial Sequence: Synthetic peptide
MFSSPSQYENL

SEQ ID NO: 1629 - protein, 11 aa, Artificial Sequence
  Description of Artificial Sequence: Synthetic peptide
MFSSPSQWENL

SEQ ID NO: 1630 - protein, 11 aa, Artificial Sequence
  Description of Artificial Sequence: Synthetic peptide
MFSSPSHPENL

SEQ ID NO: 1631 - protein, 11 aa, Artificial Sequence
  Description of Artificial Sequence: Synthetic peptide
MFSSPSHFENL

SEQ ID NO: 1632 - protein, 11 aa, Artificial Sequence
  Description of Artificial Sequence: Synthetic peptide
MFSSPSHYENL

SEQ ID NO: 1633 - protein, 11 aa, Artificial Sequence
  Description of Artificial Sequence: Synthetic peptide
MFSSPSHWENL

SEQ ID NO: 1634 - protein, 11 aa, Artificial Sequence
  Description of Artificial Sequence: Synthetic peptide
MFTSPSMPENL

SEQ ID NO: 1635 - protein, 11 aa, Artificial Sequence
  Description of Artificial Sequence: Synthetic peptide
MFTSPSMFENL

SEQ ID NO: 1636 - protein, 11 aa, Artificial Sequence
  Description of Artificial Sequence: Synthetic peptide
MFTSPSMYENL

SEQ ID NO: 1637 - protein, 11 aa, Artificial Sequence
  Description of Artificial Sequence: Synthetic peptide
MFTSPSMWENL

SEQ ID NO: 1638 - protein, 11 aa, Artificial Sequence
  Description of Artificial Sequence: Synthetic peptide
MFTSPSFPENL

SEQ ID NO: 1639 - protein, 11 aa, Artificial Sequence
  Description of Artificial Sequence: Synthetic peptide
MFTSPSFFENL

SEQ ID NO: 1640 - protein, 11 aa, Artificial Sequence
  Description of Artificial Sequence: Synthetic peptide
MFTSPSFYENL

SEQ ID NO: 1641 - protein, 11 aa, Artificial Sequence
  Description of Artificial Sequence: Synthetic peptide
MFTSPSFWENL

SEQ ID NO: 1642 - protein, 11 aa, Artificial Sequence
  Description of Artificial Sequence: Synthetic peptide
MFTSPSYPENL

SEQ ID NO: 1643 - protein, 11 aa, Artificial Sequence
  Description of Artificial Sequence: Synthetic peptide
MFTSPSYFENL

SEQ ID NO: 1644 - protein, 11 aa, Artificial Sequence
  Description of Artificial Sequence: Synthetic peptide
MFTSPSYYENL

SEQ ID NO: 1645 - protein, 11 aa, Artificial Sequence
  Description of Artificial Sequence: Synthetic peptide
MFTSPSYWENL

SEQ ID NO: 1646 - protein, 11 aa, Artificial Sequence
  Description of Artificial Sequence: Synthetic peptide
MFTSPSDPENL

SEQ ID NO: 1647 - protein, 11 aa, Artificial Sequence
  Description of Artificial Sequence: Synthetic peptide
MFTSPSDFENL

SEQ ID NO: 1648 - protein, 11 aa, Artificial Sequence
  Description of Artificial Sequence: Synthetic peptide
MFTSPSDYENL

SEQ ID NO: 1649 - protein, 11 aa, Artificial Sequence
  Description of Artificial Sequence: Synthetic peptide
MFTSPSDWENL

SEQ ID NO: 1650 - protein, 11 aa, Artificial Sequence
  Description of Artificial Sequence: Synthetic peptide
MFTSPSEPENL

SEQ ID NO: 1651 - protein, 11 aa, Artificial Sequence
  Description of Artificial Sequence: Synthetic peptide
MFTSPSEFENL

SEQ ID NO: 1652 - protein, 11 aa, Artificial Sequence
  Description of Artificial Sequence: Synthetic peptide
MFTSPSEYENL

SEQ ID NO: 1653 - protein, 11 aa, Artificial Sequence
  Description of Artificial Sequence: Synthetic peptide
MFTSPSEWENL

SEQ ID NO: 1654 - protein, 11 aa, Artificial Sequence
  Description of Artificial Sequence: Synthetic peptide
MFTSPSNPENL

SEQ ID NO: 1655 - protein, 11 aa, Artificial Sequence
  Description of Artificial Sequence: Synthetic peptide
MFTSPSNFENL

SEQ ID NO: 1656 - protein, 11 aa, Artificial Sequence
  Description of Artificial Sequence: Synthetic peptide
MFTSPSNYENL

SEQ ID NO: 1657 - protein, 11 aa, Artificial Sequence
  Description of Artificial Sequence: Synthetic peptide
MFTSPSNWENL

SEQ ID NO: 1658 - protein, 11 aa, Artificial Sequence
  Description of Artificial Sequence: Synthetic peptide
MFTSPSQPENL

SEQ ID NO: 1659 - protein, 11 aa, Artificial Sequence
  Description of Artificial Sequence: Synthetic peptide
MFTSPSQFENL

SEQ ID NO: 1660 - protein, 11 aa, Artificial Sequence
  Description of Artificial Sequence: Synthetic peptide
MFTSPSQYENL

SEQ ID NO: 1661 - protein, 11 aa, Artificial Sequence
  Description of Artificial Sequence: Synthetic peptide
MFTSPSQWENL

SEQ ID NO: 1662 - protein, 11 aa, Artificial Sequence
  Description of Artificial Sequence: Synthetic peptide
MFTSPSHPENL

SEQ ID NO: 1663 - protein, 11 aa, Artificial Sequence
  Description of Artificial Sequence: Synthetic peptide
MFTSPSHFENL

SEQ ID NO: 1664 - protein, 11 aa, Artificial Sequence
  Description of Artificial Sequence: Synthetic peptide
MFTSPSHYENL

SEQ ID NO: 1665 - protein, 11 aa, Artificial Sequence
  Description of Artificial Sequence: Synthetic peptide
MFTSPSHWENL

SEQ ID NO: 1666 - protein, 11 aa, Artificial Sequence
  Description of Artificial Sequence: Synthetic peptide
MFHSPSMPENL

SEQ ID NO: 1667 - protein, 11 aa, Artificial Sequence
  Description of Artificial Sequence: Synthetic peptide
MFHSPSMFENL

SEQ ID NO: 1668 - protein, 11 aa, Artificial Sequence
  Description of Artificial Sequence: Synthetic peptide
MFHSPSMYENL

SEQ ID NO: 1669 - protein, 11 aa, Artificial Sequence
  Description of Artificial Sequence: Synthetic peptide
MFHSPSMWENL

SEQ ID NO: 1670 - protein, 11 aa, Artificial Sequence
  Description of Artificial Sequence: Synthetic peptide
MFHSPSFPENL

SEQ ID NO: 1671 - protein, 11 aa, Artificial Sequence
  Description of Artificial Sequence: Synthetic peptide
MFHSPSFFENL

SEQ ID NO: 1672 - protein, 11 aa, Artificial Sequence
  Description of Artificial Sequence: Synthetic peptide
MFHSPSFYENL

SEQ ID NO: 1673 - protein, 11 aa, Artificial Sequence
  Description of Artificial Sequence: Synthetic peptide
MFHSPSFWENL

SEQ ID NO: 1674 - protein, 11 aa, Artificial Sequence
  Description of Artificial Sequence: Synthetic peptide
MFHSPSYPENL

SEQ ID NO: 1675 - protein, 11 aa, Artificial Sequence
  Description of Artificial Sequence: Synthetic peptide
MFHSPSYFENL

SEQ ID NO: 1676 - protein, 11 aa, Artificial Sequence
  Description of Artificial Sequence: Synthetic peptide
MFHSPSYYENL

SEQ ID NO: 1677 - protein, 11 aa, Artificial Sequence
  Description of Artificial Sequence: Synthetic peptide
MFHSPSYWENL

SEQ ID NO: 1678 - protein, 11 aa, Artificial Sequence
  Description of Artificial Sequence: Synthetic peptide
MFHSPSDPENL

SEQ ID NO: 1679 - protein, 11 aa, Artificial Sequence
  Description of Artificial Sequence: Synthetic peptide
MFHSPSDFENL

SEQ ID NO: 1680 - protein, 11 aa, Artificial Sequence
  Description of Artificial Sequence: Synthetic peptide
MFHSPSDYENL

SEQ ID NO: 1681 - protein, 11 aa, Artificial Sequence
  Description of Artificial Sequence: Synthetic peptide
MFHSPSDWENL

SEQ ID NO: 1682 - protein, 11 aa, Artificial Sequence
  Description of Artificial Sequence: Synthetic peptide
MFHSPSEPENL

SEQ ID NO: 1683 - protein, 11 aa, Artificial Sequence
  Description of Artificial Sequence: Synthetic peptide
MFHSPSEFENL

SEQ ID NO: 1684 - protein, 11 aa, Artificial Sequence
  Description of Artificial Sequence: Synthetic peptide
MFHSPSEYENL

SEQ ID NO: 1685 - protein, 11 aa, Artificial Sequence
  Description of Artificial Sequence: Synthetic peptide
MFHSPSEWENL

SEQ ID NO: 1686 - protein, 11 aa, Artificial Sequence
  Description of Artificial Sequence: Synthetic peptide
MFHSPSNPENL

SEQ ID NO: 1687 - protein, 11 aa, Artificial Sequence
  Description of Artificial Sequence: Synthetic peptide
MFHSPSNFENL

SEQ ID NO: 1688 - protein, 11 aa, Artificial Sequence
  Description of Artificial Sequence: Synthetic peptide
MFHSPSNYENL

SEQ ID NO: 1689 - protein, 11 aa, Artificial Sequence
  Description of Artificial Sequence: Synthetic peptide
MFHSPSNWENL

SEQ ID NO: 1690 - protein, 11 aa, Artificial Sequence
  Description of Artificial Sequence: Synthetic peptide
MFHSPSQPENL

SEQ ID NO: 1691 - protein, 11 aa, Artificial Sequence
  Description of Artificial Sequence: Synthetic peptide
MFHSPSQFENL

SEQ ID NO: 1692 - protein, 11 aa, Artificial Sequence
  Description of Artificial Sequence: Synthetic peptide
MFHSPSQYENL

SEQ ID NO: 1693 - protein, 11 aa, Artificial Sequence
  Description of Artificial Sequence: Synthetic peptide
MFHSPSQWENL

SEQ ID NO: 1694 - protein, 11 aa, Artificial Sequence
  Description of Artificial Sequence: Synthetic peptide
MFHSPSHPENL

SEQ ID NO: 1695 - protein, 11 aa, Artificial Sequence
  Description of Artificial Sequence: Synthetic peptide
MFHSPSHFENL

SEQ ID NO: 1696 - protein, 11 aa, Artificial Sequence
  Description of Artificial Sequence: Synthetic peptide
MFHSPSHYENL

SEQ ID NO: 1697 - protein, 11 aa, Artificial Sequence
  Description of Artificial Sequence: Synthetic peptide
MFHSPSHWENL

SEQ ID NO: 1698 - protein, 11 aa, Artificial Sequence
  Description of Artificial Sequence: Synthetic peptide
MFNSPSMPENL

SEQ ID NO: 1699 - protein, 11 aa, Artificial Sequence
  Description of Artificial Sequence: Synthetic peptide
MFNSPSMFENL

SEQ ID NO: 1700 - protein, 11 aa, Artificial Sequence
  Description of Artificial Sequence: Synthetic peptide
MFNSPSMYENL

SEQ ID NO: 1701 - protein, 11 aa, Artificial Sequence
  Description of Artificial Sequence: Synthetic peptide
MFNSPSMWENL

SEQ ID NO: 1702 - protein, 11 aa, Artificial Sequence
  Description of Artificial Sequence: Synthetic peptide
MFNSPSFPENL

SEQ ID NO: 1703 - protein, 11 aa, Artificial Sequence
  Description of Artificial Sequence: Synthetic peptide
MFNSPSFFENL

SEQ ID NO: 1704 - protein, 11 aa, Artificial Sequence
  Description of Artificial Sequence: Synthetic peptide
MFNSPSFYENL

SEQ ID NO: 1705 - protein, 11 aa, Artificial Sequence
  Description of Artificial Sequence: Synthetic peptide
MFNSPSFWENL

SEQ ID NO: 1706 - protein, 11 aa, Artificial Sequence
  Description of Artificial Sequence: Synthetic peptide
MFNSPSYPENL

SEQ ID NO: 1707 - protein, 11 aa, Artificial Sequence
  Description of Artificial Sequence: Synthetic peptide
MFNSPSYFENL

SEQ ID NO: 1708 - protein, 11 aa, Artificial Sequence
  Description of Artificial Sequence: Synthetic peptide
MFNSPSYYENL

SEQ ID NO: 1709 - protein, 11 aa, Artificial Sequence
  Description of Artificial Sequence: Synthetic peptide
MFNSPSYWENL

SEQ ID NO: 1710 - protein, 11 aa, Artificial Sequence
  Description of Artificial Sequence: Synthetic peptide
MFNSPSDPENL

SEQ ID NO: 1711 - protein, 11 aa, Artificial Sequence
  Description of Artificial Sequence: Synthetic peptide
MFNSPSDFENL

SEQ ID NO: 1712 - protein, 11 aa, Artificial Sequence
  Description of Artificial Sequence: Synthetic peptide
MFNSPSDYENL

SEQ ID NO: 1713 - protein, 11 aa, Artificial Sequence
  Description of Artificial Sequence: Synthetic peptide
MFNSPSDWENL

SEQ ID NO: 1714 - protein, 11 aa, Artificial Sequence
  Description of Artificial Sequence: Synthetic peptide
MFNSPSEPENL

SEQ ID NO: 1715 - protein, 11 aa, Artificial Sequence
  Description of Artificial Sequence: Synthetic peptide
MFNSPSEFENL

SEQ ID NO: 1716 - protein, 11 aa, Artificial Sequence
  Description of Artificial Sequence: Synthetic peptide
MFNSPSEYENL

SEQ ID NO: 1717 - protein, 11 aa, Artificial Sequence
  Description of Artificial Sequence: Synthetic peptide
MFNSPSEWENL

SEQ ID NO: 1718 - protein, 11 aa, Artificial Sequence
  Description of Artificial Sequence: Synthetic peptide
MFNSPSNPENL

SEQ ID NO: 1719 - protein, 11 aa, Artificial Sequence
  Description of Artificial Sequence: Synthetic peptide
MFNSPSNFENL

SEQ ID NO: 1720 - protein, 11 aa, Artificial Sequence
  Description of Artificial Sequence: Synthetic peptide
MFNSPSNYENL

SEQ ID NO: 1721 - protein, 11 aa, Artificial Sequence
  Description of Artificial Sequence: Synthetic peptide
MFNSPSNWENL

SEQ ID NO: 1722 - protein, 11 aa, Artificial Sequence
  Description of Artificial Sequence: Synthetic peptide
MFNSPSQPENL

SEQ ID NO: 1723 - protein, 11 aa, Artificial Sequence
  Description of Artificial Sequence: Synthetic peptide
MFNSPSQFENL

SEQ ID NO: 1724 - protein, 11 aa, Artificial Sequence
  Description of Artificial Sequence: Synthetic peptide
MFNSPSQYENL

SEQ ID NO: 1725 - protein, 11 aa, Artificial Sequence
  Description of Artificial Sequence: Synthetic peptide
MFNSPSQWENL

SEQ ID NO: 1726 - protein, 11 aa, Artificial Sequence
  Description of Artificial Sequence: Synthetic peptide
MFNSPSHPENL

SEQ ID NO: 1727 - protein, 11 aa, Artificial Sequence
  Description of Artificial Sequence: Synthetic peptide
MFNSPSHFENL

SEQ ID NO: 1728 - protein, 11 aa, Artificial Sequence
  Description of Artificial Sequence: Synthetic peptide
MFNSPSHYENL

SEQ ID NO: 1729 - protein, 11 aa, Artificial Sequence
  Description of Artificial Sequence: Synthetic peptide
MFNSPSHWENL

SEQ ID NO: 1730 - protein, 11 aa, Artificial Sequence
  Description of Artificial Sequence: Synthetic peptide
MFGSPSMPENL

SEQ ID NO: 1731 - protein, 11 aa, Artificial Sequence
  Description of Artificial Sequence: Synthetic peptide
MFGSPSMFENL

SEQ ID NO: 1732 - protein, 11 aa, Artificial Sequence
  Description of Artificial Sequence: Synthetic peptide
MFGSPSMYENL

SEQ ID NO: 1733 - protein, 11 aa, Artificial Sequence
  Description of Artificial Sequence: Synthetic peptide
MFGSPSMWENL

SEQ ID NO: 1734 - protein, 11 aa, Artificial Sequence
  Description of Artificial Sequence: Synthetic peptide
MFGSPSFPENL

SEQ ID NO: 1735 - protein, 11 aa, Artificial Sequence
  Description of Artificial Sequence: Synthetic peptide
MFGSPSFFENL

SEQ ID NO: 1736 - protein, 11 aa, Artificial Sequence
  Description of Artificial Sequence: Synthetic peptide
MFGSPSFYENL

SEQ ID NO: 1737 - protein, 11 aa, Artificial Sequence
  Description of Artificial Sequence: Synthetic peptide
MFGSPSFWENL

SEQ ID NO: 1738 - protein, 11 aa, Artificial Sequence
  Description of Artificial Sequence: Synthetic peptide
MFGSPSYPENL

SEQ ID NO: 1739 - protein, 11 aa, Artificial Sequence
  Description of Artificial Sequence: Synthetic peptide
MFGSPSYFENL

SEQ ID NO: 1740 - protein, 11 aa, Artificial Sequence
  Description of Artificial Sequence: Synthetic peptide
MFGSPSYYENL

SEQ ID NO: 1741 - protein, 11 aa, Artificial Sequence
  Description of Artificial Sequence: Synthetic peptide
MFGSPSYWENL

SEQ ID NO: 1742 - protein, 11 aa, Artificial Sequence
  Description of Artificial Sequence: Synthetic peptide
MFGSPSDPENL

SEQ ID NO: 1743 - protein, 11 aa, Artificial Sequence
  Description of Artificial Sequence: Synthetic peptide
MFGSPSDFENL

SEQ ID NO: 1744 - protein, 11 aa, Artificial Sequence
  Description of Artificial Sequence: Synthetic peptide
MFGSPSDYENL

SEQ ID NO: 1745 - protein, 11 aa, Artificial Sequence
  Description of Artificial Sequence: Synthetic peptide
MFGSPSDWENL

SEQ ID NO: 1746 - protein, 11 aa, Artificial Sequence
  Description of Artificial Sequence: Synthetic peptide
MFGSPSEPENL

SEQ ID NO: 1747 - protein, 11 aa, Artificial Sequence
  Description of Artificial Sequence: Synthetic peptide
MFGSPSEFENL

SEQ ID NO: 1748 - protein, 11 aa, Artificial Sequence
  Description of Artificial Sequence: Synthetic peptide
MFGSPSEYENL

SEQ ID NO: 1749 - protein, 11 aa, Artificial Sequence
  Description of Artificial Sequence: Synthetic peptide
MFGSPSEWENL

SEQ ID NO: 1750 - protein, 11 aa, Artificial Sequence
  Description of Artificial Sequence: Synthetic peptide
MFGSPSNPENL

SEQ ID NO: 1751 - protein, 11 aa, Artificial Sequence
  Description of Artificial Sequence: Synthetic peptide
MFGSPSNFENL

SEQ ID NO: 1752 - protein, 11 aa, Artificial Sequence
  Description of Artificial Sequence: Synthetic peptide
MFGSPSNYENL

SEQ ID NO: 1753 - protein, 11 aa, Artificial Sequence
  Description of Artificial Sequence: Synthetic peptide
MFGSPSNWENL

SEQ ID NO: 1754 - protein, 11 aa, Artificial Sequence
  Description of Artificial Sequence: Synthetic peptide
MFGSPSQPENL

SEQ ID NO: 1755 - protein, 11 aa, Artificial Sequence
  Description of Artificial Sequence: Synthetic peptide
MFGSPSQFENL

SEQ ID NO: 1756 - protein, 11 aa, Artificial Sequence
  Description of Artificial Sequence: Synthetic peptide
MFGSPSQYENL

SEQ ID NO: 1757 - protein, 11 aa, Artificial Sequence
  Description of Artificial Sequence: Synthetic peptide
MFGSPSQWENL

SEQ ID NO: 1758 - protein, 11 aa, Artificial Sequence
  Description of Artificial Sequence: Synthetic peptide
MFGSPSHPENL

SEQ ID NO: 1759 - protein, 11 aa, Artificial Sequence
  Description of Artificial Sequence: Synthetic peptide
MFGSPSHFENL

SEQ ID NO: 1760 - protein, 11 aa, Artificial Sequence
  Description of Artificial Sequence: Synthetic peptide
MFGSPSHYENL

SEQ ID NO: 1761 - protein, 11 aa, Artificial Sequence
  Description of Artificial Sequence: Synthetic peptide
MFGSPSHWENL

SEQ ID NO: 1762 - protein, 11 aa, Artificial Sequence
  Description of Artificial Sequence: Synthetic peptide
MFASPSMPENL

SEQ ID NO: 1763 - protein, 11 aa, Artificial Sequence
  Description of Artificial Sequence: Synthetic peptide
MFASPSMFENL

SEQ ID NO: 1764 - protein, 11 aa, Artificial Sequence
  Description of Artificial Sequence: Synthetic peptide
MFASPSMYENL

SEQ ID NO: 1765 - protein, 11 aa, Artificial Sequence
  Description of Artificial Sequence: Synthetic peptide
MFASPSMWENL

SEQ ID NO: 1766 - protein, 11 aa, Artificial Sequence
  Description of Artificial Sequence: Synthetic peptide
MFASPSFPENL

SEQ ID NO: 1767 - protein, 11 aa, Artificial Sequence
  Description of Artificial Sequence: Synthetic peptide
MFASPSFFENL

SEQ ID NO: 1768 - protein, 11 aa, Artificial Sequence
  Description of Artificial Sequence: Synthetic peptide
MFASPSFYENL

SEQ ID NO: 1769 - protein, 11 aa, Artificial Sequence
  Description of Artificial Sequence: Synthetic peptide
MFASPSFWENL

SEQ ID NO: 1770 - protein, 11 aa, Artificial Sequence
  Description of Artificial Sequence: Synthetic peptide
MFASPSYPENL

SEQ ID NO: 1771 - protein, 11 aa, Artificial Sequence
  Description of Artificial Sequence: Synthetic peptide
MFASPSYFENL

SEQ ID NO: 1772 - protein, 11 aa, Artificial Sequence
  Description of Artificial Sequence: Synthetic peptide
MFASPSYYENL

SEQ ID NO: 1773 - protein, 11 aa, Artificial Sequence
  Description of Artificial Sequence: Synthetic peptide
MFASPSYWENL

SEQ ID NO: 1774 - protein, 11 aa, Artificial Sequence
  Description of Artificial Sequence: Synthetic peptide
MFASPSDPENL

SEQ ID NO: 1775 - protein, 11 aa, Artificial Sequence
  Description of Artificial Sequence: Synthetic peptide
MFASPSDFENL

SEQ ID NO: 1776 - protein, 11 aa, Artificial Sequence
  Description of Artificial Sequence: Synthetic peptide
MFASPSDYENL

SEQ ID NO: 1777 - protein, 11 aa, Artificial Sequence
  Description of Artificial Sequence: Synthetic peptide
MFASPSDWENL

SEQ ID NO: 1778 - protein, 11 aa, Artificial Sequence
  Description of Artificial Sequence: Synthetic peptide
MFASPSEPENL

SEQ ID NO: 1779 - protein, 11 aa, Artificial Sequence
  Description of Artificial Sequence: Synthetic peptide
MFASPSEFENL

SEQ ID NO: 1780 - protein, 11 aa, Artificial Sequence
  Description of Artificial Sequence: Synthetic peptide
MFASPSEYENL

SEQ ID NO: 1781 - protein, 11 aa, Artificial Sequence
  Description of Artificial Sequence: Synthetic peptide
MFASPSEWENL

SEQ ID NO: 1782 - protein, 11 aa, Artificial Sequence
  Description of Artificial Sequence: Synthetic peptide
MFASPSNPENL

SEQ ID NO: 1783 - protein, 11 aa, Artificial Sequence
  Description of Artificial Sequence: Synthetic peptide
MFASPSNFENL

SEQ ID NO: 1784 - protein, 11 aa, Artificial Sequence
  Description of Artificial Sequence: Synthetic peptide
MFASPSNYENL

SEQ ID NO: 1785 - protein, 11 aa, Artificial Sequence
  Description of Artificial Sequence: Synthetic peptide
MFASPSNWENL

SEQ ID NO: 1786 - protein, 11 aa, Artificial Sequence
  Description of Artificial Sequence: Synthetic peptide
MFASPSQPENL

SEQ ID NO: 1787 - protein, 11 aa, Artificial Sequence
  Description of Artificial Sequence: Synthetic peptide
MFASPSQFENL

SEQ ID NO: 1788 - protein, 11 aa, Artificial Sequence
  Description of Artificial Sequence: Synthetic peptide
MFASPSQYENL

SEQ ID NO: 1789 - protein, 11 aa, Artificial Sequence
  Description of Artificial Sequence: Synthetic peptide
MFASPSQWENL

SEQ ID NO: 1790 - protein, 11 aa, Artificial Sequence
  Description of Artificial Sequence: Synthetic peptide
MFASPSHPENL

SEQ ID NO: 1791 - protein, 11 aa, Artificial Sequence
  Description of Artificial Sequence: Synthetic peptide
MFASPSHFENL

SEQ ID NO: 1792 - protein, 11 aa, Artificial Sequence
  Description of Artificial Sequence: Synthetic peptide
MFASPSHYENL

SEQ ID NO: 1793 - protein, 11 aa, Artificial Sequence
  Description of Artificial Sequence: Synthetic peptide
MFASPSHWENL

SEQ ID NO: 1794 - protein, 11 aa, Artificial Sequence
  Description of Artificial Sequence: Synthetic peptide
RYSLPPELSNM

SEQ ID NO: 1795 - protein, 11 aa, Artificial Sequence
  Description of Artificial Sequence: Synthetic peptide
AYRSPSMPENL

SEQ ID NO: 1796 - protein, 11 aa, Artificial Sequence
  Description of Artificial Sequence: Synthetic peptide
RYRSPSMPENL

SEQ ID NO: 1797 - protein, 11 aa, Artificial Sequence
  Description of Artificial Sequence: Synthetic peptide
NYRSPSMPENL

SEQ ID NO: 1798 - protein, 11 aa, Artificial Sequence
  Description of Artificial Sequence: Synthetic peptide
DYRSPSMPENL

SEQ ID NO: 1799 - protein, 11 aa, Artificial Sequence
  Description of Artificial Sequence: Synthetic peptide
CYRSPSMPENL

SEQ ID NO: 1800 - protein, 11 aa, Artificial Sequence
  Description of Artificial Sequence: Synthetic peptide
QYRSPSMPENL

SEQ ID NO: 1801 - protein, 11 aa, Artificial Sequence
  Description of Artificial Sequence: Synthetic peptide
EYRSPSMPENL

SEQ ID NO: 1802 - protein, 11 aa, Artificial Sequence
  Description of Artificial Sequence: Synthetic peptide
GYRSPSMPENL

SEQ ID NO: 1803 - protein, 11 aa, Artificial Sequence
  Description of Artificial Sequence: Synthetic peptide
HYRSPSMPENL

SEQ ID NO: 1804 - protein, 11 aa, Artificial Sequence
  Description of Artificial Sequence: Synthetic peptide
IYRSPSMPENL

SEQ ID NO: 1805 - protein, 11 aa, Artificial Sequence
  Description of Artificial Sequence: Synthetic peptide
LYRSPSMPENL

SEQ ID NO: 1806 - protein, 11 aa, Artificial Sequence
  Description of Artificial Sequence: Synthetic peptide
KYRSPSMPENL

SEQ ID NO: 1807 - protein, 11 aa, Artificial Sequence
  Description of Artificial Sequence: Synthetic peptide
MYRSPSMPENL

SEQ ID NO: 1808 - protein, 11 aa, Artificial Sequence
  Description of Artificial Sequence: Synthetic peptide
FYRSPSMPENL

SEQ ID NO: 1809 - protein, 11 aa, Artificial Sequence
  Description of Artificial Sequence: Synthetic peptide
PYRSPSMPENL

SEQ ID NO: 1810 - protein, 11 aa, Artificial Sequence
  Description of Artificial Sequence: Synthetic peptide
SYRSPSMPENL

SEQ ID NO: 1811 - protein, 11 aa, Artificial Sequence
  Description of Artificial Sequence: Synthetic peptide
TYRSPSMPENL

SEQ ID NO: 1812 - protein, 11 aa, Artificial Sequence
  Description of Artificial Sequence: Synthetic peptide
WYRSPSMPENL

SEQ ID NO: 1813 - protein, 11 aa, Artificial Sequence
  Description of Artificial Sequence: Synthetic peptide
YYRSPSMPENL

SEQ ID NO: 1814 - protein, 11 aa, Artificial Sequence
  Description of Artificial Sequence: Synthetic peptide
VYRSPSMPENL

SEQ ID NO: 1815 - protein, 11 aa, Artificial Sequence
  Description of Artificial Sequence: Synthetic peptide
LARSPSMPENL

SEQ ID NO: 1816 - protein, 11 aa, Artificial Sequence
  Description of Artificial Sequence: Synthetic peptide
LRRSPSMPENL

SEQ ID NO: 1817 - protein, 11 aa, Artificial Sequence
  Description of Artificial Sequence: Synthetic peptide
LNRSPSMPENL

SEQ ID NO: 1818 - protein, 11 aa, Artificial Sequence
  Description of Artificial Sequence: Synthetic peptide
LDRSPSMPENL

SEQ ID NO: 1819 - protein, 11 aa, Artificial Sequence
  Description of Artificial Sequence: Synthetic peptide
LCRSPSMPENL

SEQ ID NO: 1820 - protein, 11 aa, Artificial Sequence
  Description of Artificial Sequence: Synthetic peptide
LQRSPSMPENL

SEQ ID NO: 1821 - protein, 11 aa, Artificial Sequence
  Description of Artificial Sequence: Synthetic peptide
LERSPSMPENL

SEQ ID NO: 1822 - protein, 11 aa, Artificial Sequence
  Description of Artificial Sequence: Synthetic peptide
LGRSPSMPENL

SEQ ID NO: 1823 - protein, 11 aa, Artificial Sequence
  Description of Artificial Sequence: Synthetic peptide
LHRSPSMPENL

SEQ ID NO: 1824 - protein, 11 aa, Artificial Sequence
  Description of Artificial Sequence: Synthetic peptide
LIRSPSMPENL

SEQ ID NO: 1825 - protein, 11 aa, Artificial Sequence
  Description of Artificial Sequence: Synthetic peptide
LLRSPSMPENL

SEQ ID NO: 1826 - protein, 11 aa, Artificial Sequence
  Description of Artificial Sequence: Synthetic peptide
LKRSPSMPENL

SEQ ID NO: 1827 - protein, 11 aa, Artificial Sequence
  Description of Artificial Sequence: Synthetic peptide
LMRSPSMPENL

SEQ ID NO: 1828 - protein, 11 aa, Artificial Sequence
  Description of Artificial Sequence: Synthetic peptide
LFRSPSMPENL

SEQ ID NO: 1829 - protein, 11 aa, Artificial Sequence
  Description of Artificial Sequence: Synthetic peptide
LPRSPSMPENL

SEQ ID NO: 1830 - protein, 11 aa, Artificial Sequence
  Description of Artificial Sequence: Synthetic peptide
LSRSPSMPENL

SEQ ID NO: 1831 - protein, 11 aa, Artificial Sequence
  Description of Artificial Sequence: Synthetic peptide
LTRSPSMPENL

SEQ ID NO: 1832 - protein, 11 aa, Artificial Sequence
  Description of Artificial Sequence: Synthetic peptide
LWRSPSMPENL

SEQ ID NO: 1833 - protein, 11 aa, Artificial Sequence
  Description of Artificial Sequence: Synthetic peptide
LYRSPSMPENL

SEQ ID NO: 1834 - protein, 11 aa, Artificial Sequence
  Description of Artificial Sequence: Synthetic peptide
LVRSPSMPENL

SEQ ID NO: 1835 - protein, 11 aa, Artificial Sequence
  Description of Artificial Sequence: Synthetic peptide
LYASPSMPENL

SEQ ID NO: 1836 - protein, 11 aa, Artificial Sequence
  Description of Artificial Sequence: Synthetic peptide
LYRSPSMPENL

SEQ ID NO: 1837 - protein, 11 aa, Artificial Sequence
  Description of Artificial Sequence: Synthetic peptide
LYNSPSMPENL

SEQ ID NO: 1838 - protein, 11 aa, Artificial Sequence
  Description of Artificial Sequence: Synthetic peptide
LYDSPSMPENL

SEQ ID NO: 1839 - protein, 11 aa, Artificial Sequence
  Description of Artificial Sequence: Synthetic peptide
LYCSPSMPENL

SEQ ID NO: 1840 - protein, 11 aa, Artificial Sequence
  Description of Artificial Sequence: Synthetic peptide
LYQSPSMPENL

SEQ ID NO: 1841 - protein, 11 aa, Artificial Sequence
  Description of Artificial Sequence: Synthetic peptide
LYESPSMPENL

SEQ ID NO: 1842 - protein, 11 aa, Artificial Sequence
  Description of Artificial Sequence: Synthetic peptide
LYGSPSMPENL

SEQ ID NO: 1843 - protein, 11 aa, Artificial Sequence
  Description of Artificial Sequence: Synthetic peptide
LYHSPSMPENL

SEQ ID NO: 1844 - protein, 11 aa, Artificial Sequence
  Description of Artificial Sequence: Synthetic peptide
LYISPSMPENL

SEQ ID NO: 1845 - protein, 11 aa, Artificial Sequence
  Description of Artificial Sequence: Synthetic peptide
LYLSPSMPENL

SEQ ID NO: 1846 - protein, 11 aa, Artificial Sequence
  Description of Artificial Sequence: Synthetic peptide
LYKSPSMPENL

SEQ ID NO: 1847 - protein, 11 aa, Artificial Sequence
  Description of Artificial Sequence: Synthetic peptide
LYMSPSMPENL

SEQ ID NO: 1848 - protein, 11 aa, Artificial Sequence
  Description of Artificial Sequence: Synthetic peptide
LYFSPSMPENL

SEQ ID NO: 1849 - protein, 11 aa, Artificial Sequence
  Description of Artificial Sequence: Synthetic peptide
LYPSPSMPENL

SEQ ID NO: 1850 - protein, 11 aa, Artificial Sequence
  Description of Artificial Sequence: Synthetic peptide
LYSSPSMPENL

SEQ ID NO: 1851 - protein, 11 aa, Artificial Sequence
  Description of Artificial Sequence: Synthetic peptide
LYTSPSMPENL

SEQ ID NO: 1852 - protein, 11 aa, Artificial Sequence
  Description of Artificial Sequence: Synthetic peptide
LYWSPSMPENL

SEQ ID NO: 1853 - protein, 11 aa, Artificial Sequence
  Description of Artificial Sequence: Synthetic peptide
LYYSPSMPENL

SEQ ID NO: 1854 - protein, 11 aa, Artificial Sequence
  Description of Artificial Sequence: Synthetic peptide
LYVSPSMPENL

SEQ ID NO: 1855 - protein, 11 aa, Artificial Sequence
  Description of Artificial Sequence: Synthetic peptide
LYRSPSAPENL

SEQ ID NO: 1856 - protein, 11 aa, Artificial Sequence
  Description of Artificial Sequence: Synthetic peptide
LYRSPSRPENL

SEQ ID NO: 1857 - protein, 11 aa, Artificial Sequence
  Description of Artificial Sequence: Synthetic peptide
LYRSPSNPENL

SEQ ID NO: 1858 - protein, 11 aa, Artificial Sequence
  Description of Artificial Sequence: Synthetic peptide
LYRSPSDPENL

SEQ ID NO: 1859 - protein, 11 aa, Artificial Sequence
  Description of Artificial Sequence: Synthetic peptide
LYRSPSCPENL

SEQ ID NO: 1860 - protein, 11 aa, Artificial Sequence
  Description of Artificial Sequence: Synthetic peptide
LYRSPSQPENL

SEQ ID NO: 1861 - protein, 11 aa, Artificial Sequence
  Description of Artificial Sequence: Synthetic peptide
LYRSPSEPENL

SEQ ID NO: 1862 - protein, 11 aa, Artificial Sequence
  Description of Artificial Sequence: Synthetic peptide
LYRSPSGPENL

SEQ ID NO: 1863 - protein, 11 aa, Artificial Sequence
  Description of Artificial Sequence: Synthetic peptide
LYRSPSHPENL

SEQ ID NO: 1864 - protein, 11 aa, Artificial Sequence
  Description of Artificial Sequence: Synthetic peptide
LYRSPSIPENL

SEQ ID NO: 1865 - protein, 11 aa, Artificial Sequence
  Description of Artificial Sequence: Synthetic peptide
LYRSPSLPENL

SEQ ID NO: 1866 - protein, 11 aa, Artificial Sequence
  Description of Artificial Sequence: Synthetic peptide
LYRSPSKPENL

SEQ ID NO: 1867 - protein, 11 aa, Artificial Sequence
  Description of Artificial Sequence: Synthetic peptide
LYRSPSMPENL

SEQ ID NO: 1868 - protein, 11 aa, Artificial Sequence
  Description of Artificial Sequence: Synthetic peptide
LYRSPSFPENL

SEQ ID NO: 1869 - protein, 11 aa, Artificial Sequence
  Description of Artificial Sequence: Synthetic peptide
LYRSPSPPENL

SEQ ID NO: 1870 - protein, 11 aa, Artificial Sequence
  Description of Artificial Sequence: Synthetic peptide
LYRSPSSPENL

SEQ ID NO: 1871 - protein, 11 aa, Artificial Sequence
  Description of Artificial Sequence: Synthetic peptide
LYRSPSTPENL

SEQ ID NO: 1872 - protein, 11 aa, Artificial Sequence
  Description of Artificial Sequence: Synthetic peptide
LYRSPSWPENL

SEQ ID NO: 1873 - protein, 11 aa, Artificial Sequence
  Description of Artificial Sequence: Synthetic peptide
LYRSPSYPENL

SEQ ID NO: 1874 - protein, 11 aa, Artificial Sequence
  Description of Artificial Sequence: Synthetic peptide
LYRSPSVPENL

SEQ ID NO: 1875 - protein, 11 aa, Artificial Sequence
  Description of Artificial Sequence: Synthetic peptide
LYRSPSMAENL

SEQ ID NO: 1876 - protein, 11 aa, Artificial Sequence
  Description of Artificial Sequence: Synthetic peptide
LYRSPSMRENL

SEQ ID NO: 1877 - protein, 11 aa, Artificial Sequence
  Description of Artificial Sequence: Synthetic peptide
LYRSPSMNENL

SEQ ID NO: 1878 - protein, 11 aa, Artificial Sequence
  Description of Artificial Sequence: Synthetic peptide
LYRSPSMDENL

SEQ ID NO: 1879 - protein, 11 aa, Artificial Sequence
  Description of Artificial Sequence: Synthetic peptide
LYRSPSMCENL

SEQ ID NO: 1880 - protein, 11 aa, Artificial Sequence
  Description of Artificial Sequence: Synthetic peptide
LYRSPSMQENL

SEQ ID NO: 1881 - protein, 11 aa, Artificial Sequence
  Description of Artificial Sequence: Synthetic peptide
LYRSPSMEENL

SEQ ID NO: 1882 - protein, 11 aa, Artificial Sequence
  Description of Artificial Sequence: Synthetic peptide
LYRSPSMGENL

SEQ ID NO: 1883 - protein, 11 aa, Artificial Sequence
  Description of Artificial Sequence: Synthetic peptide
LYRSPSMHENL

SEQ ID NO: 1884 - protein, 11 aa, Artificial Sequence
  Description of Artificial Sequence: Synthetic peptide
LYRSPSMIENL

SEQ ID NO: 1885 - protein, 11 aa, Artificial Sequence
  Description of Artificial Sequence: Synthetic peptide
LYRSPSMLENL

SEQ ID NO: 1886 - protein, 11 aa, Artificial Sequence
  Description of Artificial Sequence: Synthetic peptide
LYRSPSMKENL

SEQ ID NO: 1887 - protein, 11 aa, Artificial Sequence
  Description of Artificial Sequence: Synthetic peptide
LYRSPSMMENL

SEQ ID NO: 1888 - protein, 11 aa, Artificial Sequence
  Description of Artificial Sequence: Synthetic peptide
LYRSPSMFENL

SEQ ID NO: 1889 - protein, 11 aa, Artificial Sequence
  Description of Artificial Sequence: Synthetic peptide
LYRSPSMPENL

SEQ ID NO: 1890 - protein, 11 aa, Artificial Sequence
  Description of Artificial Sequence: Synthetic peptide
LYRSPSMSENL

SEQ ID NO: 1891 - protein, 11 aa, Artificial Sequence
  Description of Artificial Sequence: Synthetic peptide
LYRSPSMTENL

SEQ ID NO: 1892 - protein, 11 aa, Artificial Sequence
  Description of Artificial Sequence: Synthetic peptide
LYRSPSMWENL

SEQ ID NO: 1893 - protein, 11 aa, Artificial Sequence
  Description of Artificial Sequence: Synthetic peptide
LYRSPSMYENL

SEQ ID NO: 1894 - protein, 11 aa, Artificial Sequence
  Description of Artificial Sequence: Synthetic peptide
LYRSPSMVENL

SEQ ID NO: 1895 - protein, 9 aa, Artificial Sequence
  Description of Artificial Sequence: Synthetic peptide
YGGPGGGGN

SEQ ID NO: 1896 - protein, 11 aa, Artificial Sequence
  Description of Artificial Sequence: Synthetic peptide
LARSASMPEAL

SEQ ID NO: 1897 - protein, 11 aa, Artificial Sequence
  Description of Artificial Sequence: Synthetic peptide
LYRSPAMPENL

SEQ ID NO: 1898 - protein, 8 aa, Artificial Sequence
  Description of Artificial Sequence: Synthetic peptide
WYRSPSYY

SEQ ID NO: 1899 - protein, 11 aa, Artificial Sequence
  Description of Artificial Sequence: Synthetic peptide
YGRKKRRQRRR

SEQ ID NO: 1900 - DNA, 2055 bp, Homo sapiens
caggaagactctgagtccgacgttggcctacccagtcggaaggcagagctgcaatctagttaactacctcctttcccctagatttcctttcattctgctcaagtcttcgcctgtgtccgatccctatctactttctctcctcttgtagcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaatgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 1901 - protein, 472 aa, Homo sapiens
MSTELFSSTREEGSSGSGPSFRSNQRKMLNLLLERDTSFTVCPDVPRTPVGKFLGDSANLSILSGGTPKCCLDLSNLSSGEITATQLTTSADLDETGHLDSSLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 1902 - protein, 476 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 1903 - protein, 542 aa, Homo sapiens
MSRESDVEAQQSHGSSACSQPHGSVTQSQGSSSQSQGISSSSTSMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 1904 - protein, 12 aa, Artificial Sequence
  Description of Artificial Sequence: Synthetic peptide
LYRSPASMPENL

SEQ ID NO: 1905 - protein, 9 aa, Artificial Sequence
  Description of Artificial Sequence: Synthetic peptide
GGRSPAMPE

SEQ ID NO: 1906 - protein, 12 aa, Artificial Sequence
  Description of Artificial Sequence: Synthetic peptide
LYRSPSAMPENL

SEQ ID NO: 1907 - protein, 11 aa, Artificial Sequence
  Description of Artificial Sequence: Synthetic peptide
  MOD_RES (8): Pro, Phe, Tyr or Trp
LYRSPSHXENL

SEQ ID NO: 1908 - protein, 11 aa, Artificial Sequence
  Description of Artificial Sequence: Synthetic peptide
  MOD_RES (8): Pro, Phe, Tyr or Trp
LYSSPSYXENL

SEQ ID NO: 1909 - protein, 11 aa, Artificial Sequence
  Description of Artificial Sequence: Synthetic peptide
  MOD_RES (8): Pro, Phe, Tyr or Trp
LYTSPSYXENL

SEQ ID NO: 1910 - protein, 11 aa, Artificial Sequence
  Description of Artificial Sequence: Synthetic peptide
  MOD_RES (8): Pro, Phe, Tyr or Trp
LYTSPSHXENL

SEQ ID NO: 1911 - protein, 11 aa, Artificial Sequence
  Description of Artificial Sequence: Synthetic peptide
  MOD_RES (8): Pro, Phe, Tyr or Trp
LYHSPSYXENL

SEQ ID NO: 1912 - protein, 11 aa, Artificial Sequence
  Description of Artificial Sequence: Synthetic peptide
  MOD_RES (8): Pro, Phe, Tyr or Trp
WYRSPSFXENL

SEQ ID NO: 1913 - protein, 11 aa, Artificial Sequence
  Description of Artificial Sequence: Synthetic peptide
  MOD_RES (8): Pro, Phe, Tyr or Trp
WYTSPSHXENL

SEQ ID NO: 1914 - protein, 11 aa, Artificial Sequence
  Description of Artificial Sequence: Synthetic peptide
  MOD_RES (8): Pro, Phe, Tyr or Trp
LFTSPSYXENL

SEQ ID NO: 1915 - protein, 11 aa, Artificial Sequence
  Description of Artificial Sequence: Synthetic peptide
  MOD_RES (8): Pro, Phe, Tyr or Trp
FYSSPSHXENL

SEQ ID NO: 1916 - protein, 11 aa, Artificial Sequence
  Description of Artificial Sequence: Synthetic peptide
  MOD_RES (8): Pro, Phe, Tyr or Trp
FYTSPSMXENL

SEQ ID NO: 1917 - protein, 11 aa, Artificial Sequence
  Description of Artificial Sequence: Synthetic peptide
  MOD_RES (8): Pro, Phe, Tyr or Trp
FYTSPSFXENL

SEQ ID NO: 1918 - protein, 11 aa, Artificial Sequence
  Description of Artificial Sequence: Synthetic peptide
  MOD_RES (8): Pro, Phe, Tyr or Trp
FYTSPSYXENL

SEQ ID NO: 1919 - protein, 11 aa, Artificial Sequence
  Description of Artificial Sequence: Synthetic peptide
  MOD_RES (8): Pro, Phe, Tyr or Trp
WYTSPSMXENL

SEQ ID NO: 1920 - protein, 11 aa, Artificial Sequence
  Description of Artificial Sequence: Synthetic peptide
  MOD_RES (8): Pro, Phe, Tyr or Trp
WYTSPSFXENL

SEQ ID NO: 1921 - protein, 11 aa, Artificial Sequence
  Description of Artificial Sequence: Synthetic peptide
  MOD_RES (8): Pro, Phe, Tyr or Trp
WYTSPSYXENL

SEQ ID NO: 1922 - protein, 11 aa, Artificial Sequence
  Description of Artificial Sequence: Synthetic peptide
LARSASMPEAL

SEQ ID NO: 1923 - protein, 11 aa, Artificial Sequence
  Description of Artificial Sequence: Synthetic peptide
RYSLPPELSNM

SEQ ID NO: 1924 - protein, 11 aa, Artificial Sequence
  Description of Artificial Sequence: Synthetic peptide
LYRSPAMPENL

SEQ ID NO: 1925 - protein, 11 aa, Artificial Sequence
  Description of Artificial Sequence: Synthetic peptide
LYRSPSMPENL

SEQ ID NO: 1926 - protein, 11 aa, Artificial Sequence
  Description of Artificial Sequence: Synthetic peptide
  MOD_RES (1): Any amino acid
  MOD_RES (11): Any amino acid
XYGGPGGGGNX

SEQ ID NO: 1927 - protein, 11 aa, Artificial Sequence
  Description of Artificial Sequence: Synthetic peptide
  MOD_RES (1): Any amino acid
  MOD_RES (11): Any amino acid
XYGGGGGGGNX

SEQ ID NO: 1928 - protein, 11 aa, Artificial Sequence
  Description of Artificial Sequence: Synthetic peptide
  MOD_RES (1): Any amino acid
  MOD_RES (9): Any amino acid
  MOD_RES (11): Any amino acid
XYGGGGGGXNX

SEQ ID NO: 1929 - protein, 11 aa, Artificial Sequence
  Description of Artificial Sequence: Synthetic peptide
  MOD_RES (1): Any amino acid
  MOD_RES (8): Any amino acid
  MOD_RES (9): Any amino acid
  MOD_RES (11): Any amino acid
XYGGGGGXXNX

SEQ ID NO: 1930 - protein, 9 aa, Artificial Sequence
  Description of Artificial Sequence: Synthetic peptide
  MOD_RES (2)..(3): Gly, Leu, Ser or Arg
  MOD_RES (6)..(8): Gly, Leu, Ser, Met, Pro or Glu
YXXPSXXXN

SEQ ID NO: 1931 - protein, 6 aa, Artificial Sequence
  Description of Artificial Sequence: Synthetic peptide
GGSPSM

SEQ ID NO: 1932 - protein, 22 aa, Artificial Sequence
  Description of Artificial Sequence: Synthetic peptide
YGRKKRRQRRRLYRSPSMPENL

SEQ ID NO: 1933 - protein, 22 aa, Artificial Sequence
  Description of Artificial Sequence: Synthetic peptide
YGRKKRRQRRRLYRSPAMPENL

SEQ ID NO: 1934 - protein, 20 aa, Artificial Sequence
  Description of Artificial Sequence: Synthetic peptide
YGRKKRRQRRRGGRSPAMPE

SEQ ID NO: 1935 - protein, 22 aa, Artificial Sequence
  Description of Artificial Sequence: Synthetic peptide
YGRKKRRQRRRLARSASMPEAL

SEQ ID NO: 1936 - protein, 20 aa, Artificial Sequence
  Description of Artificial Sequence: Synthetic peptide
YGRKKRRQRRRYGGPGGGGN

SEQ ID NO: 1937 - protein, 22 aa, Artificial Sequence
  Description of Artificial Sequence: Synthetic peptide
YGRKKRRQRRRYLSRSPPMNEL

SEQ ID NO: 1938 - protein, 22 aa, Artificial Sequence
  Description of Artificial Sequence: Synthetic peptide
YGRKKRRQRRRRYSLPPELSNM

SEQ ID NO: 1939 - protein, 18 aa, Artificial Sequence
  Description of Artificial Sequence: Synthetic peptide
YGRKKRRQRRRGGSPAMP

SEQ ID NO: 1940 - protein, 19 aa, Artificial Sequence
  Description of Artificial Sequence: Synthetic peptide
YGRKKRRQRRRGGRSPSMP

SEQ ID NO: 1941 - protein, 18 aa, Artificial Sequence
  Description of Artificial Sequence: Synthetic peptide
YGRKKRRQRRRGGSPSMP

SEQ ID NO: 1942 - protein, 17 aa, Artificial Sequence
  Description of Artificial Sequence: Synthetic peptide
YGRKKRRQRRRGGSPAM

SEQ ID NO: 1943 - protein, 17 aa, Artificial Sequence
  Description of Artificial Sequence: Synthetic peptide
YGRKKRRQRRRGGSPSM

SEQ ID NO: 1944 - protein, 20 aa, Artificial Sequence
  Description of Artificial Sequence: Synthetic peptide
YGRKKRRQRRRYGGGGGGGN

SEQ ID NO: 1945 - protein, 19 aa, Artificial Sequence
  Description of Artificial Sequence: Synthetic peptide
YGRKKRRQRRRYGGGGGGN

SEQ ID NO: 1946 - protein, 18 aa, Artificial Sequence
  Description of Artificial Sequence: Synthetic peptide
YGRKKRRQRRRYGGGGGN

SEQ ID NO: 1947 - protein, 20 aa, Artificial Sequence
  Description of Artificial Sequence: Synthetic peptide
YGRKKRRQRRRYPYDVPDYA

SEQ ID NO: 1948 - protein, 22 aa, Artificial Sequence
  Description of Artificial Sequence: Synthetic peptide
YGRKKRRQRRRGGDYKDDDDKG

SEQ ID NO: 1949 - protein, 11 aa, Artificial sequence
  Description of artificial sequence: Synthetic peptide
  SITE (1)..(1): Xaa is Leu, Phe, Trp, Met, Arg, Ile, Val, Tyr, Lys or absent
  SITE (2)..(2): Xaa is Tyr, Phe, Ala, Trp, Ser or Thr
  SITE (3)..(3): Xaa is any amino acid
  SITE (4)..(4): Xaa is any amino acid
  SITE (5)..(5): Xaa is any amino acid
  SITE (6)..(6): Xaa is Ser, Ala, Asn, His or Pro
  SITE (7)..(7): Xaa is any amino acid
  SITE (8)..(8): Xaa is any amino acid
  SITE (9)..(9): Xaa is any amino acid or absent
  SITE (10)..(10): Xaa is Asn, Gly, Leu, Ser, Met, Pro, Asn, Ala or absent
  SITE (11)..(11): Xaa is Leu or absent
XXXXXXXXXXX

What is claimed is:

1. An isolated or recombinant polypeptide comprising the amino acid sequence:

$$X_1 X_2 X_3 X_4 X_5 X_6 X_7 X_8 X_9 X_{10} X_{11}$$

wherein X1 is L, F, W, M, R, I, V, Y, K, or absent,
X2 is Y, F, A, W, S or T,
X3 is R, S, G, T, or H,
X4 is S, L, P or G,
X5 is P, A, or G,
X6 is S, A, N, H, G, or P,
X7 is M, E, G, H, Q, Y, or F,
X8 is P, L, G, F, W or Y,
X9 is E, S, N, G, or absent,
X10 is N, G, L, S, M, P, N, A, or absent, and
X11 is L, M, or absent,
wherein the amino acid sequence is selected from the group consisting of R Y S L P P E L S N M (SEQ ID NO: 1), L Y T S P S Y Y E N L (SEQ ID NO: 76), L Y H S P S Y Y E N L (SEQ ID NO: 108), L F T S P S Y Y E N L (SEQ ID NO: 300), W Y R S P S F Y E N L (SEQ ID NO: 904), W Y T S P S H P E N L (SEQ ID NO: 990), Y G G P G G G N (SEQ ID NO: 1895), and L A R S A S M P E A L (SEQ ID NO: 1896), and wherein the polypeptide can be a phosphorylation substrate of a human Chk2 kinase in vitro.

2. The isolated or recombinant polypeptide of claim 1, wherein the amino acid sequence comprises Y G G P G G G G N (SEQ ID NO: 1895).

3. The isolated or recombinant polypeptide of claim 1, wherein the amino acid sequence comprises R Y S L P P E L S N M (SEQ ID NO: 1).

4. The isolated or recombinant polypeptide of claim 1, comprising the amino acid sequence L A R S A S M P E A L (SEQ ID NO: 1896).

5. The isolated or recombinant polypeptide of claim 1, comprising the amino acid sequence W Y R SP S F Y E N L (SEQ ID NO: 904).

6. The isolated or recombinant polypeptide of claim 1, comprising the amino acid sequence L Y T S P S Y Y E N L (SEQ ID NO: 76).

7. The isolated or recombinant polypeptide of claim 1, comprising the amino acid sequence L Y H S P S Y Y E N L (SEQ ID NO: 108).

8. The isolated or recombinant polypeptide of claim 1, comprising the amino acid sequence L F T S P S Y Y E N L (SEQ ID NO: 300).

9. The isolated or recombinant polypeptide of claim 1, comprising the amino acid sequence W Y T S P S H P E N L (SEQ ID NO: 990).

10. The isolated or recombinant polypeptide of claim 1, further comprising a cell membrane permeant.

11. The isolated or recombinant polypeptide of claim 10, wherein the cell membrane permeant comprises a polypeptide.

12. The isolated or recombinant polypeptide of claim 11, wherein the polypeptide comprises a TAT protein transduction domain.

13. The isolated or recombinant polypeptide of claim 12, wherein the TAT protein transduction domain is Y G R K K R R Q R R R (SEQ ID NO: 1899).

14. The isolated or recombinant polypeptide of claim 10, wherein the cell membrane permeant comprises a lipid.

15. The isolated or recombinant polypeptide of claim 14, wherein the cell membrane permeant comprises a liposome.

16. A chimeric polypeptide comprising a first domain comprising a polypeptide as set forth in claim 1 and a second domain comprising a cell membrane permeant.

17. The chimeric polypeptide of claim 16, wherein the polypeptide is a recombinant fusion protein.

18. A pharmaceutical composition comprising a polypeptide as set forth in claim 1 or claim 16 and a pharmaceutically acceptable excipient.

19. The pharmaceutical composition of claim 18 comprising a liposome.

* * * * *